United States Patent 12,258,599 (METHOD TO INACTIVATE A MUTANT ALLELE OF AN ELANE GENE) - sequence listing, part 2

SEQ ID NO: 30558 - RNA, 20 nt, Artificial Sequence
  ELANE RNA Guide
guccucgaagcguuggauga

SEQ ID NO: 30559 - RNA, 20 nt, Artificial Sequence
  ELANE RNA Guide
guggggacagggguuguccu

SEQ ID NO: 30560 - RNA, 20 nt, Artificial Sequence
  ELANE RNA Guide
guuguccucgaagcguugga

SEQ ID NO: 30561 - RNA, 20 nt, Artificial Sequence
  ELANE RNA Guide
uaucauccaacgcuucgagg

SEQ ID NO: 30562 - RNA, 20 nt, Artificial Sequence
  ELANE RNA Guide
ucauccaacgcuucgaggac

SEQ ID NO: 30563 - RNA, 20 nt, Artificial Sequence
  ELANE RNA Guide
uccaacgcuucgaggacaac

SEQ ID NO: 30564 - RNA, 20 nt, Artificial Sequence
  ELANE RNA Guide
uccucgaagcguuggaugau

SEQ ID NO: 30565 - RNA, 20 nt, Artificial Sequence
  ELANE RNA Guide
ucgaagcguuggaugauaga

SEQ ID NO: 30566 - RNA, 20 nt, Artificial Sequence
  ELANE RNA Guide
ucgacucuaucauccaacgc

SEQ ID NO: 30567 - RNA, 20 nt, Artificial Sequence
  ELANE RNA Guide
ucuaucauccaacgcuucga

SEQ ID NO: 30568 - RNA, 20 nt, Artificial Sequence
  ELANE RNA Guide
uggggacagggguuguccuc

SEQ ID NO: 30569 - RNA, 20 nt, Artificial Sequence
  ELANE RNA Guide
uguccucgaagcguuggaug

SEQ ID NO: 30570 - RNA, 20 nt, Artificial Sequence
  ELANE RNA Guide
uucgaggacaaccccugucc

SEQ ID NO: 30571 - RNA, 20 nt, Artificial Sequence
  ELANE RNA Guide
uuguccucgaagcguuggau

SEQ ID NO: 30572 - RNA, 21 nt, Artificial Sequence
  ELANE RNA Guide
aacgcuucgaggacaaccccu

SEQ ID NO: 30573 - RNA, 21 nt, Artificial Sequence
  ELANE RNA Guide
acagggguuguccucgaagcg

SEQ ID NO: 30574 - RNA, 21 nt, Artificial Sequence
  ELANE RNA Guide
acgcuucgaggacaaccccug

SEQ ID NO: 30575 - RNA, 21 nt, Artificial Sequence
  ELANE RNA Guide
acucuaucauccaacgcuucg

SEQ ID NO: 30576 - RNA, 21 nt, Artificial Sequence
  ELANE RNA Guide
agggguuguccucgaagcguu

SEQ ID NO: 30577 - RNA, 21 nt, Artificial Sequence
  ELANE RNA Guide
aucauccaacgcuucgaggac

SEQ ID NO: 30578 - RNA, 21 nt, Artificial Sequence
  ELANE RNA Guide
auccaacgcuucgaggacaac

SEQ ID NO: 30579 - RNA, 21 nt, Artificial Sequence
  ELANE RNA Guide
aucgacucuaucauccaacgc

SEQ ID NO: 30580 - RNA, 21 nt, Artificial Sequence
  ELANE RNA Guide
caacgcuucgaggacaacccc

SEQ ID NO: 30581 - RNA, 21 nt, Artificial Sequence
  ELANE RNA Guide
cagggguuguccucgaagcgu

SEQ ID NO: 30582 - RNA, 21 nt, Artificial Sequence
  ELANE RNA Guide
cauccaacgcuucgaggacaa

SEQ ID NO: 30583 - RNA, 21 nt, Artificial Sequence
  ELANE RNA Guide
ccaacgcuucgaggacaaccc

SEQ ID NO: 30584 - RNA, 21 nt, Artificial Sequence
  ELANE RNA Guide
ccucgaagcguuggaugauag

SEQ ID NO: 30585 - RNA, 21 nt, Artificial Sequence
  ELANE RNA Guide
cgaagcguuggaugauagagu

SEQ ID NO: 30586 - RNA, 21 nt, Artificial Sequence
  ELANE RNA Guide
cgacucuaucauccaacgcuu

SEQ ID NO: 30587 - RNA, 21 nt, Artificial Sequence
  ELANE RNA Guide
cgcuucgaggacaaccccugu

SEQ ID NO: 30588 - RNA, 21 nt, Artificial Sequence
  ELANE RNA Guide
cuaucauccaacgcuucgagg

SEQ ID NO: 30589 - RNA, 21 nt, Artificial Sequence
  ELANE RNA Guide
cucgaagcguuggaugauaga

SEQ ID NO: 30590 - RNA, 21 nt, Artificial Sequence
  ELANE RNA Guide
cucuaucauccaacgcuucga

SEQ ID NO: 30591 - RNA, 21 nt, Artificial Sequence
  ELANE RNA Guide
cuucgaggacaaccccugucc

SEQ ID NO: 30592 - RNA, 21 nt, Artificial Sequence
  ELANE RNA Guide
gaagcguuggaugauagaguc

SEQ ID NO: 30593 - RNA, 21 nt, Artificial Sequence
  ELANE RNA Guide
gacagggguuguccucgaagc

SEQ ID NO: 30594 - RNA, 21 nt, Artificial Sequence
  ELANE RNA Guide
gacucuaucauccaacgcuuc

SEQ ID NO: 30595 - RNA, 21 nt, Artificial Sequence
  ELANE RNA Guide
gaucgacucuaucauccaacg

SEQ ID NO: 30596 - RNA, 21 nt, Artificial Sequence
  ELANE RNA Guide
gcuucgaggacaaccccuguc

SEQ ID NO: 30597 - RNA, 21 nt, Artificial Sequence
  ELANE RNA Guide
ggacagggguuguccucgaag

SEQ ID NO: 30598 - RNA, 21 nt, Artificial Sequence
  ELANE RNA Guide
ggaucgacucuaucauccaac

SEQ ID NO: 30599 - RNA, 21 nt, Artificial Sequence
  ELANE RNA Guide
gggacagggguuguccucgaa

SEQ ID NO: 30600 - RNA, 21 nt, Artificial Sequence
  ELANE RNA Guide
ggggacagggguuguccucga

SEQ ID NO: 30601 - RNA, 21 nt, Artificial Sequence
  ELANE RNA Guide
gggguuguccucgaagcguug

SEQ ID NO: 30602 - RNA, 21 nt, Artificial Sequence
  ELANE RNA Guide
ggguggggacagggguugucc

SEQ ID NO: 30603 - RNA, 21 nt, Artificial Sequence
  ELANE RNA Guide
ggguuguccucgaagcguugg

SEQ ID NO: 30604 - RNA, 21 nt, Artificial Sequence
  ELANE RNA Guide
gguggggacagggguuguccu

SEQ ID NO: 30605 - RNA, 21 nt, Artificial Sequence
  ELANE RNA Guide
gguuguccucgaagcguugga

SEQ ID NO: 30606 - RNA, 21 nt, Artificial Sequence
  ELANE RNA Guide
guccucgaagcguuggaugau

SEQ ID NO: 30607 - RNA, 21 nt, Artificial Sequence
  ELANE RNA Guide
guggggacagggguuguccuc

SEQ ID NO: 30608 - RNA, 21 nt, Artificial Sequence
  ELANE RNA Guide
guuguccucgaagcguuggau

SEQ ID NO: 30609 - RNA, 21 nt, Artificial Sequence
  ELANE RNA Guide
uaucauccaacgcuucgagga

SEQ ID NO: 30610 - RNA, 21 nt, Artificial Sequence
  ELANE RNA Guide
ucauccaacgcuucgaggaca

SEQ ID NO: 30611 - RNA, 21 nt, Artificial Sequence
  ELANE RNA Guide
uccaacgcuucgaggacaacc

SEQ ID NO: 30612 - RNA, 21 nt, Artificial Sequence
  ELANE RNA Guide
uccucgaagcguuggaugaua

SEQ ID NO: 30613 - RNA, 21 nt, Artificial Sequence
  ELANE RNA Guide
ucgaagcguuggaugauagag

SEQ ID NO: 30614 - RNA, 21 nt, Artificial Sequence
  ELANE RNA Guide
ucgacucuaucauccaacgcu

SEQ ID NO: 30615 - RNA, 21 nt, Artificial Sequence
  ELANE RNA Guide
ucuaucauccaacgcuucgag

SEQ ID NO: 30616 - RNA, 21 nt, Artificial Sequence
  ELANE RNA Guide
uggggacagggguuguccucg

SEQ ID NO: 30617 - RNA, 21 nt, Artificial Sequence
  ELANE RNA Guide
uguccucgaagcguuggauga

SEQ ID NO: 30618 - RNA, 21 nt, Artificial Sequence
  ELANE RNA Guide
uucgaggacaaccccuguccc

SEQ ID NO: 30619 - RNA, 21 nt, Artificial Sequence
  ELANE RNA Guide
uuguccucgaagcguuggaug

SEQ ID NO: 30620 - RNA, 22 nt, Artificial Sequence
  ELANE RNA Guide
aacgcuucgaggacaaccccug

SEQ ID NO: 30621 - RNA, 22 nt, Artificial Sequence
  ELANE RNA Guide
acagggguuguccucgaagcgu

SEQ ID NO: 30622 - RNA, 22 nt, Artificial Sequence
  ELANE RNA Guide
acgcuucgaggacaaccccugu

SEQ ID NO: 30623 - RNA, 22 nt, Artificial Sequence
  ELANE RNA Guide
acucuaucauccaacgcuucga

SEQ ID NO: 30624 - RNA, 22 nt, Artificial Sequence
  ELANE RNA Guide
agggguuguccucgaagcguug

SEQ ID NO: 30625 - RNA, 22 nt, Artificial Sequence
  ELANE RNA Guide
aucauccaacgcuucgaggaca

SEQ ID NO: 30626 - RNA, 22 nt, Artificial Sequence
  ELANE RNA Guide
auccaacgcuucgaggacaacc

SEQ ID NO: 30627 - RNA, 22 nt, Artificial Sequence
  ELANE RNA Guide
aucgacucuaucauccaacgcu

SEQ ID NO: 30628 - RNA, 22 nt, Artificial Sequence
  ELANE RNA Guide
caacgcuucgaggacaaccccu

SEQ ID NO: 30629 - RNA, 22 nt, Artificial Sequence
  ELANE RNA Guide
cagggguuguccucgaagcguu

SEQ ID NO: 30630 - RNA, 22 nt, Artificial Sequence
  ELANE RNA Guide
cauccaacgcuucgaggacaac

SEQ ID NO: 30631 - RNA, 22 nt, Artificial Sequence
  ELANE RNA Guide
ccaacgcuucgaggacaacccc

SEQ ID NO: 30632 - RNA, 22 nt, Artificial Sequence
  ELANE RNA Guide
ccucgaagcguuggaugauaga

SEQ ID NO: 30633 - RNA, 22 nt, Artificial Sequence
  ELANE RNA Guide
cgaagcguuggaugauagaguc

SEQ ID NO: 30634 - RNA, 22 nt, Artificial Sequence
  ELANE RNA Guide
cgacucuaucauccaacgcuuc

SEQ ID NO: 30635 - RNA, 22 nt, Artificial Sequence
  ELANE RNA Guide
cgcuucgaggacaaccccuguc

SEQ ID NO: 30636 - RNA, 22 nt, Artificial Sequence
  ELANE RNA Guide
cuaucauccaacgcuucgagga

SEQ ID NO: 30637 - RNA, 22 nt, Artificial Sequence
  ELANE RNA Guide
cucgaagcguuggaugauagag

SEQ ID NO: 30638 - RNA, 22 nt, Artificial Sequence
  ELANE RNA Guide
cucuaucauccaacgcuucgag

SEQ ID NO: 30639 - RNA, 22 nt, Artificial Sequence
  ELANE RNA Guide
cuucgaggacaaccccuguccc

SEQ ID NO: 30640 - RNA, 22 nt, Artificial Sequence
  ELANE RNA Guide
gaagcguuggaugauagagucg

SEQ ID NO: 30641 - RNA, 22 nt, Artificial Sequence
  ELANE RNA Guide
gacagggguuguccucgaagcg

SEQ ID NO: 30642 - RNA, 22 nt, Artificial Sequence
  ELANE RNA Guide
gacucuaucauccaacgcuucg

SEQ ID NO: 30643 - RNA, 22 nt, Artificial Sequence
  ELANE RNA Guide
gaucgacucuaucauccaacgc

SEQ ID NO: 30644 - RNA, 22 nt, Artificial Sequence
  ELANE RNA Guide
gcuucgaggacaaccccugucc

SEQ ID NO: 30645 - RNA, 22 nt, Artificial Sequence
  ELANE RNA Guide
ggacagggguuguccucgaagc

SEQ ID NO: 30646 - RNA, 22 nt, Artificial Sequence
  ELANE RNA Guide
ggaucgacucuaucauccaacg

SEQ ID NO: 30647 - RNA, 22 nt, Artificial Sequence
  ELANE RNA Guide
gggacagggguuguccucgaag

SEQ ID NO: 30648 - RNA, 22 nt, Artificial Sequence
  ELANE RNA Guide
ggggacagggguuguccucgaa

SEQ ID NO: 30649 - RNA, 22 nt, Artificial Sequence
  ELANE RNA Guide
gggguggggacagggguugucc

SEQ ID NO: 30650 - RNA, 22 nt, Artificial Sequence
  ELANE RNA Guide
gggguuguccucgaagcguugg

SEQ ID NO: 30651 - RNA, 22 nt, Artificial Sequence
  ELANE RNA Guide
ggguggggacagggguuguccu

SEQ ID NO: 30652 - RNA, 22 nt, Artificial Sequence
  ELANE RNA Guide
ggguuguccucgaagcguugga

SEQ ID NO: 30653 - RNA, 22 nt, Artificial Sequence
  ELANE RNA Guide
gguggggacagggguuguccuc

SEQ ID NO: 30654 - RNA, 22 nt, Artificial Sequence
  ELANE RNA Guide
gguuguccucgaagcguuggau

SEQ ID NO: 30655 - RNA, 22 nt, Artificial Sequence
  ELANE RNA Guide
guccucgaagcguuggaugaua

SEQ ID NO: 30656 - RNA, 22 nt, Artificial Sequence
  ELANE RNA Guide
guggggacagggguuguccucg

SEQ ID NO: 30657 - RNA, 22 nt, Artificial Sequence
  ELANE RNA Guide
guuguccucgaagcguuggaug

SEQ ID NO: 30658 - RNA, 22 nt, Artificial Sequence
  ELANE RNA Guide
uaucauccaacgcuucgaggac

SEQ ID NO: 30659 - RNA, 22 nt, Artificial Sequence
  ELANE RNA Guide
ucauccaacgcuucgaggacaa

SEQ ID NO: 30660 - RNA, 22 nt, Artificial Sequence
  ELANE RNA Guide
uccaacgcuucgaggacaaccc

SEQ ID NO: 30661 - RNA, 22 nt, Artificial Sequence
  ELANE RNA Guide
uccucgaagcguuggaugauag

SEQ ID NO: 30662 - RNA, 22 nt, Artificial Sequence
  ELANE RNA Guide
ucgaagcguuggaugauagagu

SEQ ID NO: 30663 - RNA, 22 nt, Artificial Sequence
  ELANE RNA Guide
ucgacucuaucauccaacgcuu

SEQ ID NO: 30664 - RNA, 22 nt, Artificial Sequence
  ELANE RNA Guide
ucuaucauccaacgcuucgagg

SEQ ID NO: 30665 - RNA, 22 nt, Artificial Sequence
  ELANE RNA Guide
uggaucgacucuaucauccaac

SEQ ID NO: 30666 - RNA, 22 nt, Artificial Sequence
  ELANE RNA Guide
uggggacagggguuguccucga

SEQ ID NO: 30667 - RNA, 22 nt, Artificial Sequence
  ELANE RNA Guide
uguccucgaagcguuggaugau

SEQ ID NO: 30668 - RNA, 22 nt, Artificial Sequence
  ELANE RNA Guide
uucgaggacaaccccugucccc

SEQ ID NO: 30669 - RNA, 22 nt, Artificial Sequence
  ELANE RNA Guide
uuguccucgaagcguuggauga

SEQ ID NO: 30670 - RNA, 20 nt, Artificial Sequence
  ELANE RNA Guide
aacgcuccaaggacaacccc

SEQ ID NO: 30671 - RNA, 20 nt, Artificial Sequence
  ELANE RNA Guide
acagggguuguccuuggagc

SEQ ID NO: 30672 - RNA, 20 nt, Artificial Sequence
  ELANE RNA Guide
acgcuccaaggacaaccccu

SEQ ID NO: 30673 - RNA, 20 nt, Artificial Sequence
  ELANE RNA Guide
acucuaucauccaacgcucc

SEQ ID NO: 30674 - RNA, 20 nt, Artificial Sequence
  ELANE RNA Guide
agggguuguccuuggagcgu

SEQ ID NO: 30675 - RNA, 20 nt, Artificial Sequence
  ELANE RNA Guide
aucauccaacgcuccaagga

SEQ ID NO: 30676 - RNA, 20 nt, Artificial Sequence
  ELANE RNA Guide
auccaacgcuccaaggacaa

SEQ ID NO: 30677 - RNA, 20 nt, Artificial Sequence
  ELANE RNA Guide
caacgcuccaaggacaaccc

SEQ ID NO: 30678 - RNA, 20 nt, Artificial Sequence
  ELANE RNA Guide
caaggacaaccccugucccc

SEQ ID NO: 30679 - RNA, 20 nt, Artificial Sequence
  ELANE RNA Guide
cagggguuguccuuggagcg

SEQ ID NO: 30680 - RNA, 20 nt, Artificial Sequence
  ELANE RNA Guide
cauccaacgcuccaaggaca

SEQ ID NO: 30681 - RNA, 20 nt, Artificial Sequence
  ELANE RNA Guide
ccaacgcuccaaggacaacc

SEQ ID NO: 30682 - RNA, 20 nt, Artificial Sequence
  ELANE RNA Guide
ccaaggacaaccccuguccc

SEQ ID NO: 30683 - RNA, 20 nt, Artificial Sequence
  ELANE RNA Guide
ccuuggagcguuggaugaua

SEQ ID NO: 30684 - RNA, 20 nt, Artificial Sequence
  ELANE RNA Guide
cgcuccaaggacaaccccug

SEQ ID NO: 30685 - RNA, 20 nt, Artificial Sequence
  ELANE RNA Guide
cuaucauccaacgcuccaag

SEQ ID NO: 30686 - RNA, 20 nt, Artificial Sequence
  ELANE RNA Guide
cuccaaggacaaccccuguc

SEQ ID NO: 30687 - RNA, 20 nt, Artificial Sequence
  ELANE RNA Guide
cucuaucauccaacgcucca

SEQ ID NO: 30688 - RNA, 20 nt, Artificial Sequence
  ELANE RNA Guide
cuuggagcguuggaugauag

SEQ ID NO: 30689 - RNA, 20 nt, Artificial Sequence
  ELANE RNA Guide
gacagggguuguccuuggag

SEQ ID NO: 30690 - RNA, 20 nt, Artificial Sequence
  ELANE RNA Guide
gacucuaucauccaacgcuc

SEQ ID NO: 30691 - RNA, 20 nt, Artificial Sequence
  ELANE RNA Guide
gcuccaaggacaaccccugu

SEQ ID NO: 30692 - RNA, 20 nt, Artificial Sequence
  ELANE RNA Guide
ggacagggguuguccuugga

SEQ ID NO: 30693 - RNA, 20 nt, Artificial Sequence
  ELANE RNA Guide
gggacagggguuguccuugg

SEQ ID NO: 30694 - RNA, 20 nt, Artificial Sequence
  ELANE RNA Guide
ggggacagggguuguccuug

SEQ ID NO: 30695 - RNA, 20 nt, Artificial Sequence
  ELANE RNA Guide
gggguggggacagggguugu

SEQ ID NO: 30696 - RNA, 20 nt, Artificial Sequence
  ELANE RNA Guide
gggguuguccuuggagcguu

SEQ ID NO: 30697 - RNA, 20 nt, Artificial Sequence
  ELANE RNA Guide
ggguggggacagggguuguc

SEQ ID NO: 30698 - RNA, 20 nt, Artificial Sequence
  ELANE RNA Guide
ggguuguccuuggagcguug

SEQ ID NO: 30699 - RNA, 20 nt, Artificial Sequence
  ELANE RNA Guide
gguuguccuuggagcguugg

SEQ ID NO: 30700 - RNA, 20 nt, Artificial Sequence
  ELANE RNA Guide
guccuuggagcguuggauga

SEQ ID NO: 30701 - RNA, 20 nt, Artificial Sequence
  ELANE RNA Guide
guuguccuuggagcguugga

SEQ ID NO: 30702 - RNA, 20 nt, Artificial Sequence
  ELANE RNA Guide
uaucauccaacgcuccaagg

SEQ ID NO: 30703 - RNA, 20 nt, Artificial Sequence
  ELANE RNA Guide
ucauccaacgcuccaaggac

SEQ ID NO: 30704 - RNA, 20 nt, Artificial Sequence
  ELANE RNA Guide
uccaacgcuccaaggacaac

SEQ ID NO: 30705 - RNA, 20 nt, Artificial Sequence
  ELANE RNA Guide
uccaaggacaaccccugucc

SEQ ID NO: 30706 - RNA, 20 nt, Artificial Sequence
  ELANE RNA Guide
uccuuggagcguuggaugau

SEQ ID NO: 30707 - RNA, 20 nt, Artificial Sequence
  ELANE RNA Guide
ucuaucauccaacgcuccaa

SEQ ID NO: 30708 - RNA, 20 nt, Artificial Sequence
  ELANE RNA Guide
uggggacagggguuguccuu

SEQ ID NO: 30709 - RNA, 20 nt, Artificial Sequence
  ELANE RNA Guide
uguccuuggagcguuggaug

SEQ ID NO: 30710 - RNA, 20 nt, Artificial Sequence
  ELANE RNA Guide
uuggagcguuggaugauaga

SEQ ID NO: 30711 - RNA, 20 nt, Artificial Sequence
  ELANE RNA Guide
uuguccuuggagcguuggau

SEQ ID NO: 30712 - RNA, 21 nt, Artificial Sequence
  ELANE RNA Guide
aacgcuccaaggacaaccccu

SEQ ID NO: 30713 - RNA, 21 nt, Artificial Sequence
  ELANE RNA Guide
acagggguuguccuuggagcg

SEQ ID NO: 30714 - RNA, 21 nt, Artificial Sequence
  ELANE RNA Guide
acgcuccaaggacaaccccug

SEQ ID NO: 30715 - RNA, 21 nt, Artificial Sequence
  ELANE RNA Guide
acucuaucauccaacgcucca

SEQ ID NO: 30716 - RNA, 21 nt, Artificial Sequence
  ELANE RNA Guide
agggguuguccuuggagcguu

SEQ ID NO: 30717 - RNA, 21 nt, Artificial Sequence
  ELANE RNA Guide
aucauccaacgcuccaaggac

SEQ ID NO: 30718 - RNA, 21 nt, Artificial Sequence
  ELANE RNA Guide
auccaacgcuccaaggacaac

SEQ ID NO: 30719 - RNA, 21 nt, Artificial Sequence
  ELANE RNA Guide
caacgcuccaaggacaacccc

SEQ ID NO: 30720 - RNA, 21 nt, Artificial Sequence
  ELANE RNA Guide
caaggacaaccccugucccca

SEQ ID NO: 30721 - RNA, 21 nt, Artificial Sequence
  ELANE RNA Guide
cagggguuguccuuggagcgu

SEQ ID NO: 30722 - RNA, 21 nt, Artificial Sequence
  ELANE RNA Guide
cauccaacgcuccaaggacaa

SEQ ID NO: 30723 - RNA, 21 nt, Artificial Sequence
  ELANE RNA Guide
ccaacgcuccaaggacaaccc

SEQ ID NO: 30724 - RNA, 21 nt, Artificial Sequence
  ELANE RNA Guide
ccaaggacaaccccugucccc

SEQ ID NO: 30725 - RNA, 21 nt, Artificial Sequence
  ELANE RNA Guide
ccuuggagcguuggaugauag

SEQ ID NO: 30726 - RNA, 21 nt, Artificial Sequence
  ELANE RNA Guide
cgacucuaucauccaacgcuc

SEQ ID NO: 30727 - RNA, 21 nt, Artificial Sequence
  ELANE RNA Guide
cgcuccaaggacaaccccugu

SEQ ID NO: 30728 - RNA, 21 nt, Artificial Sequence
  ELANE RNA Guide
cuaucauccaacgcuccaagg

SEQ ID NO: 30729 - RNA, 21 nt, Artificial Sequence
  ELANE RNA Guide
cuccaaggacaaccccugucc

SEQ ID NO: 30730 - RNA, 21 nt, Artificial Sequence
  ELANE RNA Guide
cucuaucauccaacgcuccaa

SEQ ID NO: 30731 - RNA, 21 nt, Artificial Sequence
  ELANE RNA Guide
cuuggagcguuggaugauaga

SEQ ID NO: 30732 - RNA, 21 nt, Artificial Sequence
  ELANE RNA Guide
gacagggguuguccuuggagc

SEQ ID NO: 30733 - RNA, 21 nt, Artificial Sequence
  ELANE RNA Guide
gacucuaucauccaacgcucc

SEQ ID NO: 30734 - RNA, 21 nt, Artificial Sequence
  ELANE RNA Guide
gcuccaaggacaaccccuguc

SEQ ID NO: 30735 - RNA, 21 nt, Artificial Sequence
  ELANE RNA Guide
ggacagggguuguccuuggag

SEQ ID NO: 30736 - RNA, 21 nt, Artificial Sequence
  ELANE RNA Guide
gggacagggguuguccuugga

SEQ ID NO: 30737 - RNA, 21 nt, Artificial Sequence
  ELANE RNA Guide
ggggacagggguuguccuugg

SEQ ID NO: 30738 - RNA, 21 nt, Artificial Sequence
  ELANE RNA Guide
ggggguggggacagggguugu

SEQ ID NO: 30739 - RNA, 21 nt, Artificial Sequence
  ELANE RNA Guide
gggguggggacagggguuguc

SEQ ID NO: 30740 - RNA, 21 nt, Artificial Sequence
  ELANE RNA Guide
gggguuguccuuggagcguug

SEQ ID NO: 30741 - RNA, 21 nt, Artificial Sequence
  ELANE RNA Guide
ggguuguccuuggagcguugg

SEQ ID NO: 30742 - RNA, 21 nt, Artificial Sequence
  ELANE RNA Guide
gguuguccuuggagcguugga

SEQ ID NO: 30743 - RNA, 21 nt, Artificial Sequence
  ELANE RNA Guide
guccuuggagcguuggaugau

SEQ ID NO: 30744 - RNA, 21 nt, Artificial Sequence
  ELANE RNA Guide
guggggacagggguuguccuu

SEQ ID NO: 30745 - RNA, 21 nt, Artificial Sequence
  ELANE RNA Guide
guuguccuuggagcguuggau

SEQ ID NO: 30746 - RNA, 21 nt, Artificial Sequence
  ELANE RNA Guide
uaucauccaacgcuccaagga

SEQ ID NO: 30747 - RNA, 21 nt, Artificial Sequence
  ELANE RNA Guide
ucauccaacgcuccaaggaca

SEQ ID NO: 30748 - RNA, 21 nt, Artificial Sequence
  ELANE RNA Guide
uccaacgcuccaaggacaacc

SEQ ID NO: 30749 - RNA, 21 nt, Artificial Sequence
  ELANE RNA Guide
uccaaggacaaccccuguccc

SEQ ID NO: 30750 - RNA, 21 nt, Artificial Sequence
  ELANE RNA Guide
uccuuggagcguuggaugaua

SEQ ID NO: 30751 - RNA, 21 nt, Artificial Sequence
  ELANE RNA Guide
ucuaucauccaacgcuccaag

SEQ ID NO: 30752 - RNA, 21 nt, Artificial Sequence
  ELANE RNA Guide
uggggacagggguuguccuug

SEQ ID NO: 30753 - RNA, 21 nt, Artificial Sequence
  ELANE RNA Guide
uguccuuggagcguuggauga

SEQ ID NO: 30754 - RNA, 21 nt, Artificial Sequence
  ELANE RNA Guide
uuggagcguuggaugauagag

SEQ ID NO: 30755 - RNA, 21 nt, Artificial Sequence
  ELANE RNA Guide
uuguccuuggagcguuggaug

SEQ ID NO: 30756 - RNA, 22 nt, Artificial Sequence
  ELANE RNA Guide
aacgcuccaaggacaaccccug

SEQ ID NO: 30757 - RNA, 22 nt, Artificial Sequence
  ELANE RNA Guide
acagggguuguccuuggagcgu

SEQ ID NO: 30758 - RNA, 22 nt, Artificial Sequence
  ELANE RNA Guide
acgcuccaaggacaaccccugu

SEQ ID NO: 30759 - RNA, 22 nt, Artificial Sequence
  ELANE RNA Guide
acucuaucauccaacgcuccaa

SEQ ID NO: 30760 - RNA, 22 nt, Artificial Sequence
  ELANE RNA Guide
agggguuguccuuggagcguug

SEQ ID NO: 30761 - RNA, 22 nt, Artificial Sequence
  ELANE RNA Guide
aucauccaacgcuccaaggaca

SEQ ID NO: 30762 - RNA, 22 nt, Artificial Sequence
  ELANE RNA Guide
auccaacgcuccaaggacaacc

SEQ ID NO: 30763 - RNA, 22 nt, Artificial Sequence
  ELANE RNA Guide
caacgcuccaaggacaaccccu

SEQ ID NO: 30764 - RNA, 22 nt, Artificial Sequence
  ELANE RNA Guide
caaggacaaccccuguccccac

SEQ ID NO: 30765 - RNA, 22 nt, Artificial Sequence
  ELANE RNA Guide
cagggguuguccuuggagcguu

SEQ ID NO: 30766 - RNA, 22 nt, Artificial Sequence
  ELANE RNA Guide
cauccaacgcuccaaggacaac

SEQ ID NO: 30767 - RNA, 22 nt, Artificial Sequence
  ELANE RNA Guide
ccaacgcuccaaggacaacccc

SEQ ID NO: 30768 - RNA, 22 nt, Artificial Sequence
  ELANE RNA Guide
ccaaggacaaccccugucccca

SEQ ID NO: 30769 - RNA, 22 nt, Artificial Sequence
  ELANE RNA Guide
ccuuggagcguuggaugauaga

SEQ ID NO: 30770 - RNA, 22 nt, Artificial Sequence
  ELANE RNA Guide
cgacucuaucauccaacgcucc

SEQ ID NO: 30771 - RNA, 22 nt, Artificial Sequence
  ELANE RNA Guide
cgcuccaaggacaaccccuguc

SEQ ID NO: 30772 - RNA, 22 nt, Artificial Sequence
  ELANE RNA Guide
cggggguggggacagggguugu

SEQ ID NO: 30773 - RNA, 22 nt, Artificial Sequence
  ELANE RNA Guide
cuaucauccaacgcuccaagga

SEQ ID NO: 30774 - RNA, 22 nt, Artificial Sequence
  ELANE RNA Guide
cuccaaggacaaccccuguccc

SEQ ID NO: 30775 - RNA, 22 nt, Artificial Sequence
  ELANE RNA Guide
cucuaucauccaacgcuccaag

SEQ ID NO: 30776 - RNA, 22 nt, Artificial Sequence
  ELANE RNA Guide
cuuggagcguuggaugauagag

SEQ ID NO: 30777 - RNA, 22 nt, Artificial Sequence
  ELANE RNA Guide
gacagggguuguccuuggagcg

SEQ ID NO: 30778 - RNA, 22 nt, Artificial Sequence
  ELANE RNA Guide
gacucuaucauccaacgcucca

SEQ ID NO: 30779 - RNA, 22 nt, Artificial Sequence
  ELANE RNA Guide
gcuccaaggacaaccccugucc

SEQ ID NO: 30780 - RNA, 22 nt, Artificial Sequence
  ELANE RNA Guide
ggacagggguuguccuuggagc

SEQ ID NO: 30781 - RNA, 22 nt, Artificial Sequence
  ELANE RNA Guide
gggacagggguuguccuuggag

SEQ ID NO: 30782 - RNA, 22 nt, Artificial Sequence
  ELANE RNA Guide
ggggacagggguuguccuugga

SEQ ID NO: 30783 - RNA, 22 nt, Artificial Sequence
  ELANE RNA Guide
ggggguggggacagggguuguc

SEQ ID NO: 30784 - RNA, 22 nt, Artificial Sequence
  ELANE RNA Guide
gggguuguccuuggagcguugg

SEQ ID NO: 30785 - RNA, 22 nt, Artificial Sequence
  ELANE RNA Guide
ggguuguccuuggagcguugga

SEQ ID NO: 30786 - RNA, 22 nt, Artificial Sequence
  ELANE RNA Guide
gguggggacagggguuguccuu

SEQ ID NO: 30787 - RNA, 22 nt, Artificial Sequence
  ELANE RNA Guide
gguuguccuuggagcguuggau

SEQ ID NO: 30788 - RNA, 22 nt, Artificial Sequence
  ELANE RNA Guide
guccuuggagcguuggaugaua

SEQ ID NO: 30789 - RNA, 22 nt, Artificial Sequence
  ELANE RNA Guide
guggggacagggguuguccuug

SEQ ID NO: 30790 - RNA, 22 nt, Artificial Sequence
  ELANE RNA Guide
guuguccuuggagcguuggaug

SEQ ID NO: 30791 - RNA, 22 nt, Artificial Sequence
  ELANE RNA Guide
uaucauccaacgcuccaaggac

SEQ ID NO: 30792 - RNA, 22 nt, Artificial Sequence
  ELANE RNA Guide
ucauccaacgcuccaaggacaa

SEQ ID NO: 30793 - RNA, 22 nt, Artificial Sequence
  ELANE RNA Guide
uccaacgcuccaaggacaaccc

SEQ ID NO: 30794 - RNA, 22 nt, Artificial Sequence
  ELANE RNA Guide
uccaaggacaaccccugucccc

SEQ ID NO: 30795 - RNA, 22 nt, Artificial Sequence
  ELANE RNA Guide
uccuuggagcguuggaugauag

SEQ ID NO: 30796 - RNA, 22 nt, Artificial Sequence
  ELANE RNA Guide
ucgacucuaucauccaacgcuc

SEQ ID NO: 30797 - RNA, 22 nt, Artificial Sequence
  ELANE RNA Guide
ucuaucauccaacgcuccaagg

SEQ ID NO: 30798 - RNA, 22 nt, Artificial Sequence
  ELANE RNA Guide
uggggacagggguuguccuugg

SEQ ID NO: 30799 - RNA, 22 nt, Artificial Sequence
  ELANE RNA Guide
uguccuuggagcguuggaugau

SEQ ID NO: 30800 - RNA, 22 nt, Artificial Sequence
  ELANE RNA Guide
uuggagcguuggaugauagagu

SEQ ID NO: 30801 - RNA, 22 nt, Artificial Sequence
  ELANE RNA Guide
uuguccuuggagcguuggauga

SEQ ID NO: 30802 - RNA, 20 nt, Artificial Sequence
  ELANE RNA Guide
aacgcuccgaguacaacccc

SEQ ID NO: 30803 - RNA, 20 nt, Artificial Sequence
  ELANE RNA Guide
acagggguuguacucggagc

SEQ ID NO: 30804 - RNA, 20 nt, Artificial Sequence
  ELANE RNA Guide
acgcuccgaguacaaccccu

SEQ ID NO: 30805 - RNA, 20 nt, Artificial Sequence
  ELANE RNA Guide
agggguuguacucggagcgu

SEQ ID NO: 30806 - RNA, 20 nt, Artificial Sequence
  ELANE RNA Guide
aguacaaccccuguccccac

SEQ ID NO: 30807 - RNA, 20 nt, Artificial Sequence
  ELANE RNA Guide
aucauccaacgcuccgagua

SEQ ID NO: 30808 - RNA, 20 nt, Artificial Sequence
  ELANE RNA Guide
auccaacgcuccgaguacaa

SEQ ID NO: 30809 - RNA, 20 nt, Artificial Sequence
  ELANE RNA Guide
caacgcuccgaguacaaccc

SEQ ID NO: 30810 - RNA, 20 nt, Artificial Sequence
  ELANE RNA Guide
cagggguuguacucggagcg

SEQ ID NO: 30811 - RNA, 20 nt, Artificial Sequence
  ELANE RNA Guide
cauccaacgcuccgaguaca

SEQ ID NO: 30812 - RNA, 20 nt, Artificial Sequence
  ELANE RNA Guide
ccaacgcuccgaguacaacc

SEQ ID NO: 30813 - RNA, 20 nt, Artificial Sequence
  ELANE RNA Guide
ccgaguacaaccccuguccc

SEQ ID NO: 30814 - RNA, 20 nt, Artificial Sequence
  ELANE RNA Guide
ccggggguggggacaggggu

SEQ ID NO: 30815 - RNA, 20 nt, Artificial Sequence
  ELANE RNA Guide
cgaguacaaccccugucccc

SEQ ID NO: 30816 - RNA, 20 nt, Artificial Sequence
  ELANE RNA Guide
cgcuccgaguacaaccccug

SEQ ID NO: 30817 - RNA, 20 nt, Artificial Sequence
  ELANE RNA Guide
cggggguggggacagggguu

SEQ ID NO: 30818 - RNA, 20 nt, Artificial Sequence
  ELANE RNA Guide
cuaucauccaacgcuccgag

SEQ ID NO: 30819 - RNA, 20 nt, Artificial Sequence
  ELANE RNA Guide
cuccgaguacaaccccuguc

SEQ ID NO: 30820 - RNA, 20 nt, Artificial Sequence
  ELANE RNA Guide
cucuaucauccaacgcuccg

SEQ ID NO: 30821 - RNA, 20 nt, Artificial Sequence
  ELANE RNA Guide
gacagggguuguacucggag

SEQ ID NO: 30822 - RNA, 20 nt, Artificial Sequence
  ELANE RNA Guide
gaguacaaccccugucccca

SEQ ID NO: 30823 - RNA, 20 nt, Artificial Sequence
  ELANE RNA Guide
gcuccgaguacaaccccugu

SEQ ID NO: 30824 - RNA, 20 nt, Artificial Sequence
  ELANE RNA Guide
ggacagggguuguacucgga

SEQ ID NO: 30825 - RNA, 20 nt, Artificial Sequence
  ELANE RNA Guide
gggacagggguuguacucgg

SEQ ID NO: 30826 - RNA, 20 nt, Artificial Sequence
  ELANE RNA Guide
ggggacagggguuguacucg

SEQ ID NO: 30827 - RNA, 20 nt, Artificial Sequence
  ELANE RNA Guide
ggggguggggacagggguug

SEQ ID NO: 30828 - RNA, 20 nt, Artificial Sequence
  ELANE RNA Guide
gggguuguacucggagcguu

SEQ ID NO: 30829 - RNA, 20 nt, Artificial Sequence
  ELANE RNA Guide
ggguggggacagggguugua

SEQ ID NO: 30830 - RNA, 20 nt, Artificial Sequence
  ELANE RNA Guide
ggguuguacucggagcguug

SEQ ID NO: 30831 - RNA, 20 nt, Artificial Sequence
  ELANE RNA Guide
gguggggacagggguuguac

SEQ ID NO: 30832 - RNA, 20 nt, Artificial Sequence
  ELANE RNA Guide
gguuguacucggagcguugg

SEQ ID NO: 30833 - RNA, 20 nt, Artificial Sequence
  ELANE RNA Guide
guacaaccccuguccccacc

SEQ ID NO: 30834 - RNA, 20 nt, Artificial Sequence
  ELANE RNA Guide
guacucggagcguuggauga

SEQ ID NO: 30835 - RNA, 20 nt, Artificial Sequence
  ELANE RNA Guide
guggggacagggguuguacu

SEQ ID NO: 30836 - RNA, 20 nt, Artificial Sequence
  ELANE RNA Guide
guuguacucggagcguugga

SEQ ID NO: 30837 - RNA, 20 nt, Artificial Sequence
  ELANE RNA Guide
uacucggagcguuggaugau

SEQ ID NO: 30838 - RNA, 20 nt, Artificial Sequence
  ELANE RNA Guide
uaucauccaacgcuccgagu

SEQ ID NO: 30839 - RNA, 20 nt, Artificial Sequence
  ELANE RNA Guide
ucauccaacgcuccgaguac

SEQ ID NO: 30840 - RNA, 20 nt, Artificial Sequence
  ELANE RNA Guide
uccaacgcuccgaguacaac

SEQ ID NO: 30841 - RNA, 20 nt, Artificial Sequence
  ELANE RNA Guide
uccgaguacaaccccugucc

SEQ ID NO: 30842 - RNA, 20 nt, Artificial Sequence
  ELANE RNA Guide
ucuaucauccaacgcuccga

SEQ ID NO: 30843 - RNA, 20 nt, Artificial Sequence
  ELANE RNA Guide
uggggacagggguuguacuc

SEQ ID NO: 30844 - RNA, 20 nt, Artificial Sequence
  ELANE RNA Guide
uguacucggagcguuggaug

SEQ ID NO: 30845 - RNA, 20 nt, Artificial Sequence
  ELANE RNA Guide
uuguacucggagcguuggau

SEQ ID NO: 30846 - RNA, 21 nt, Artificial Sequence
  ELANE RNA Guide
aacgcuccgaguacaaccccu

SEQ ID NO: 30847 - RNA, 21 nt, Artificial Sequence
  ELANE RNA Guide
acagggguuguacucggagcg

SEQ ID NO: 30848 - RNA, 21 nt, Artificial Sequence
  ELANE RNA Guide
acgcuccgaguacaaccccug

SEQ ID NO: 30849 - RNA, 21 nt, Artificial Sequence
  ELANE RNA Guide
acucuaucauccaacgcuccg

SEQ ID NO: 30850 - RNA, 21 nt, Artificial Sequence
  ELANE RNA Guide
agggguuguacucggagcguu

SEQ ID NO: 30851 - RNA, 21 nt, Artificial Sequence
  ELANE RNA Guide
aguacaaccccuguccccacc

SEQ ID NO: 30852 - RNA, 21 nt, Artificial Sequence
  ELANE RNA Guide
aucauccaacgcuccgaguac

SEQ ID NO: 30853 - RNA, 21 nt, Artificial Sequence
  ELANE RNA Guide
auccaacgcuccgaguacaac

SEQ ID NO: 30854 - RNA, 21 nt, Artificial Sequence
  ELANE RNA Guide
caacgcuccgaguacaacccc

SEQ ID NO: 30855 - RNA, 21 nt, Artificial Sequence
  ELANE RNA Guide
cagggguuguacucggagcgu

SEQ ID NO: 30856 - RNA, 21 nt, Artificial Sequence
  ELANE RNA Guide
cauccaacgcuccgaguacaa

SEQ ID NO: 30857 - RNA, 21 nt, Artificial Sequence
  ELANE RNA Guide
ccaacgcuccgaguacaaccc

SEQ ID NO: 30858 - RNA, 21 nt, Artificial Sequence
  ELANE RNA Guide
ccgaguacaaccccugucccc

SEQ ID NO: 30859 - RNA, 21 nt, Artificial Sequence
  ELANE RNA Guide
ccggggguggggacagggguu

SEQ ID NO: 30860 - RNA, 21 nt, Artificial Sequence
  ELANE RNA Guide
cgaguacaaccccugucccca

SEQ ID NO: 30861 - RNA, 21 nt, Artificial Sequence
  ELANE RNA Guide
cgcuccgaguacaaccccugu

SEQ ID NO: 30862 - RNA, 21 nt, Artificial Sequence
  ELANE RNA Guide
cggggguggggacagggguug

SEQ ID NO: 30863 - RNA, 21 nt, Artificial Sequence
  ELANE RNA Guide
cuaucauccaacgcuccgagu

SEQ ID NO: 30864 - RNA, 21 nt, Artificial Sequence
  ELANE RNA Guide
cuccgaguacaaccccugucc

SEQ ID NO: 30865 - RNA, 21 nt, Artificial Sequence
  ELANE RNA Guide
cucuaucauccaacgcuccga

SEQ ID NO: 30866 - RNA, 21 nt, Artificial Sequence
  ELANE RNA Guide
gacagggguuguacucggagc

SEQ ID NO: 30867 - RNA, 21 nt, Artificial Sequence
  ELANE RNA Guide
gaguacaaccccuguccccac

SEQ ID NO: 30868 - RNA, 21 nt, Artificial Sequence
  ELANE RNA Guide
gcuccgaguacaaccccuguc

SEQ ID NO: 30869 - RNA, 21 nt, Artificial Sequence
  ELANE RNA Guide
ggacagggguuguacucggag

SEQ ID NO: 30870 - RNA, 21 nt, Artificial Sequence
  ELANE RNA Guide
gggacagggguuguacucgga

SEQ ID NO: 30871 - RNA, 21 nt, Artificial Sequence
  ELANE RNA Guide
ggggacagggguuguacucgg

SEQ ID NO: 30872 - RNA, 21 nt, Artificial Sequence
  ELANE RNA Guide
gggguggggacagggguugua

SEQ ID NO: 30873 - RNA, 21 nt, Artificial Sequence
  ELANE RNA Guide
gggguuguacucggagcguug

SEQ ID NO: 30874 - RNA, 21 nt, Artificial Sequence
  ELANE RNA Guide
ggguggggacagggguuguac

SEQ ID NO: 30875 - RNA, 21 nt, Artificial Sequence
  ELANE RNA Guide
ggguuguacucggagcguugg

SEQ ID NO: 30876 - RNA, 21 nt, Artificial Sequence
  ELANE RNA Guide
gguggggacagggguuguacu

SEQ ID NO: 30877 - RNA, 21 nt, Artificial Sequence
  ELANE RNA Guide
gguuguacucggagcguugga

SEQ ID NO: 30878 - RNA, 21 nt, Artificial Sequence
  ELANE RNA Guide
guacaaccccuguccccaccc

SEQ ID NO: 30879 - RNA, 21 nt, Artificial Sequence
  ELANE RNA Guide
guacucggagcguuggaugau

SEQ ID NO: 30880 - RNA, 21 nt, Artificial Sequence
  ELANE RNA Guide
guggggacagggguuguacuc

SEQ ID NO: 30881 - RNA, 21 nt, Artificial Sequence
  ELANE RNA Guide
guuguacucggagcguuggau

SEQ ID NO: 30882 - RNA, 21 nt, Artificial Sequence
  ELANE RNA Guide
uacucggagcguuggaugaua

SEQ ID NO: 30883 - RNA, 21 nt, Artificial Sequence
  ELANE RNA Guide
uaucauccaacgcuccgagua

SEQ ID NO: 30884 - RNA, 21 nt, Artificial Sequence
  ELANE RNA Guide
ucauccaacgcuccgaguaca

SEQ ID NO: 30885 - RNA, 21 nt, Artificial Sequence
  ELANE RNA Guide
uccaacgcuccgaguacaacc

SEQ ID NO: 30886 - RNA, 21 nt, Artificial Sequence
  ELANE RNA Guide
uccgaguacaaccccuguccc

SEQ ID NO: 30887 - RNA, 21 nt, Artificial Sequence
  ELANE RNA Guide
ucuaucauccaacgcuccgag

SEQ ID NO: 30888 - RNA, 21 nt, Artificial Sequence
  ELANE RNA Guide
uggggacagggguuguacucg

SEQ ID NO: 30889 - RNA, 21 nt, Artificial Sequence
  ELANE RNA Guide
uguacucggagcguuggauga

SEQ ID NO: 30890 - RNA, 21 nt, Artificial Sequence
  ELANE RNA Guide
uuguacucggagcguuggaug

SEQ ID NO: 30891 - RNA, 22 nt, Artificial Sequence
  ELANE RNA Guide
aacgcuccgaguacaaccccug

SEQ ID NO: 30892 - RNA, 22 nt, Artificial Sequence
  ELANE RNA Guide
acagggguuguacucggagcgu

SEQ ID NO: 30893 - RNA, 22 nt, Artificial Sequence
  ELANE RNA Guide
acgcuccgaguacaaccccugu

SEQ ID NO: 30894 - RNA, 22 nt, Artificial Sequence
  ELANE RNA Guide
acucuaucauccaacgcuccga

SEQ ID NO: 30895 - RNA, 22 nt, Artificial Sequence
  ELANE RNA Guide
agggguuguacucggagcguug

SEQ ID NO: 30896 - RNA, 22 nt, Artificial Sequence
  ELANE RNA Guide
aguacaaccccuguccccaccc

SEQ ID NO: 30897 - RNA, 22 nt, Artificial Sequence
  ELANE RNA Guide
aucauccaacgcuccgaguaca

SEQ ID NO: 30898 - RNA, 22 nt, Artificial Sequence
  ELANE RNA Guide
auccaacgcuccgaguacaacc

SEQ ID NO: 30899 - RNA, 22 nt, Artificial Sequence
  ELANE RNA Guide
caacgcuccgaguacaaccccu

SEQ ID NO: 30900 - RNA, 22 nt, Artificial Sequence
  ELANE RNA Guide
cagggguuguacucggagcguu

SEQ ID NO: 30901 - RNA, 22 nt, Artificial Sequence
  ELANE RNA Guide
cauccaacgcuccgaguacaac

SEQ ID NO: 30902 - RNA, 22 nt, Artificial Sequence
  ELANE RNA Guide
ccaacgcuccgaguacaacccc

SEQ ID NO: 30903 - RNA, 22 nt, Artificial Sequence
  ELANE RNA Guide
cccggggguggggacagggguu

SEQ ID NO: 30904 - RNA, 22 nt, Artificial Sequence
  ELANE RNA Guide
ccgaguacaaccccugucccca

SEQ ID NO: 30905 - RNA, 22 nt, Artificial Sequence
  ELANE RNA Guide
ccggggguggggacagggguug

SEQ ID NO: 30906 - RNA, 22 nt, Artificial Sequence
  ELANE RNA Guide
cgaguacaaccccuguccccac

SEQ ID NO: 30907 - RNA, 22 nt, Artificial Sequence
  ELANE RNA Guide
cgcuccgaguacaaccccuguc

SEQ ID NO: 30908 - RNA, 22 nt, Artificial Sequence
  ELANE RNA Guide
cuaucauccaacgcuccgagua

SEQ ID NO: 30909 - RNA, 22 nt, Artificial Sequence
  ELANE RNA Guide
cuccgaguacaaccccuguccc

SEQ ID NO: 30910 - RNA, 22 nt, Artificial Sequence
  ELANE RNA Guide
cucuaucauccaacgcuccgag

SEQ ID NO: 30911 - RNA, 22 nt, Artificial Sequence
  ELANE RNA Guide
gacagggguuguacucggagcg

SEQ ID NO: 30912 - RNA, 22 nt, Artificial Sequence
  ELANE RNA Guide
gacucuaucauccaacgcuccg

SEQ ID NO: 30913 - RNA, 22 nt, Artificial Sequence
  ELANE RNA Guide
gaguacaaccccuguccccacc

SEQ ID NO: 30914 - RNA, 22 nt, Artificial Sequence
  ELANE RNA Guide
gcuccgaguacaaccccugucc

SEQ ID NO: 30915 - RNA, 22 nt, Artificial Sequence
  ELANE RNA Guide
ggacagggguuguacucggagc

SEQ ID NO: 30916 - RNA, 22 nt, Artificial Sequence
  ELANE RNA Guide
gggacagggguuguacucggag

SEQ ID NO: 30917 - RNA, 22 nt, Artificial Sequence
  ELANE RNA Guide
ggggacagggguuguacucgga

SEQ ID NO: 30918 - RNA, 22 nt, Artificial Sequence
  ELANE RNA Guide
ggggguggggacagggguugua

SEQ ID NO: 30919 - RNA, 22 nt, Artificial Sequence
  ELANE RNA Guide
gggguggggacagggguuguac

SEQ ID NO: 30920 - RNA, 22 nt, Artificial Sequence
  ELANE RNA Guide
gggguuguacucggagcguugg

SEQ ID NO: 30921 - RNA, 22 nt, Artificial Sequence
  ELANE RNA Guide
ggguggggacagggguuguacu

SEQ ID NO: 30922 - RNA, 22 nt, Artificial Sequence
  ELANE RNA Guide
ggguuguacucggagcguugga

SEQ ID NO: 30923 - RNA, 22 nt, Artificial Sequence
  ELANE RNA Guide
gguggggacagggguuguacuc

SEQ ID NO: 30924 - RNA, 22 nt, Artificial Sequence
  ELANE RNA Guide
gguuguacucggagcguuggau

SEQ ID NO: 30925 - RNA, 22 nt, Artificial Sequence
  ELANE RNA Guide
guacaaccccuguccccacccc

SEQ ID NO: 30926 - RNA, 22 nt, Artificial Sequence
  ELANE RNA Guide
guacucggagcguuggaugaua

SEQ ID NO: 30927 - RNA, 22 nt, Artificial Sequence
  ELANE RNA Guide
guggggacagggguuguacucg

SEQ ID NO: 30928 - RNA, 22 nt, Artificial Sequence
  ELANE RNA Guide
guuguacucggagcguuggaug

SEQ ID NO: 30929 - RNA, 22 nt, Artificial Sequence
  ELANE RNA Guide
uacucggagcguuggaugauag

SEQ ID NO: 30930 - RNA, 22 nt, Artificial Sequence
  ELANE RNA Guide
uaucauccaacgcuccgaguac

SEQ ID NO: 30931 - RNA, 22 nt, Artificial Sequence
  ELANE RNA Guide
ucauccaacgcuccgaguacaa

SEQ ID NO: 30932 - RNA, 22 nt, Artificial Sequence
  ELANE RNA Guide
uccaacgcuccgaguacaaccc

SEQ ID NO: 30933 - RNA, 22 nt, Artificial Sequence
  ELANE RNA Guide
ucccggggguggggacaggggu

SEQ ID NO: 30934 - RNA, 22 nt, Artificial Sequence
  ELANE RNA Guide
uccgaguacaaccccugucccc

SEQ ID NO: 30935 - RNA, 22 nt, Artificial Sequence
  ELANE RNA Guide
ucuaucauccaacgcuccgagu

SEQ ID NO: 30936 - RNA, 22 nt, Artificial Sequence
  ELANE RNA Guide
uggggacagggguuguacucgg

SEQ ID NO: 30937 - RNA, 22 nt, Artificial Sequence
  ELANE RNA Guide
uguacucggagcguuggaugau

SEQ ID NO: 30938 - RNA, 22 nt, Artificial Sequence
  ELANE RNA Guide
uuguacucggagcguuggauga

SEQ ID NO: 30939 - RNA, 20 nt, Artificial Sequence
  ELANE RNA Guide
acccccgggacccggacucg

SEQ ID NO: 30940 - RNA, 20 nt, Artificial Sequence
  ELANE RNA Guide
acccggacucggccagcagg

SEQ ID NO: 30941 - RNA, 20 nt, Artificial Sequence
  ELANE RNA Guide
acucggccagcaggacccac

SEQ ID NO: 30942 - RNA, 20 nt, Artificial Sequence
  ELANE RNA Guide
aguggguccugcuggccgag

SEQ ID NO: 30943 - RNA, 20 nt, Artificial Sequence
  ELANE RNA Guide
cacccccgggacccggacuc

SEQ ID NO: 30944 - RNA, 20 nt, Artificial Sequence
  ELANE RNA Guide
caguggguccugcuggccga

SEQ ID NO: 30945 - RNA, 20 nt, Artificial Sequence
  ELANE RNA Guide
ccacccccgggacccggacu

SEQ ID NO: 30946 - RNA, 20 nt, Artificial Sequence
  ELANE RNA Guide
cccggacucggccagcagga

SEQ ID NO: 30947 - RNA, 20 nt, Artificial Sequence
  ELANE RNA Guide
ccggacucggccagcaggac

SEQ ID NO: 30948 - RNA, 20 nt, Artificial Sequence
  ELANE RNA Guide
ccgggacccggacucggcca

SEQ ID NO: 30949 - RNA, 20 nt, Artificial Sequence
  ELANE RNA Guide
ccugcuggccgaguccgggu

SEQ ID NO: 30950 - RNA, 20 nt, Artificial Sequence
  ELANE RNA Guide
cgaguccgggucccgggggu

SEQ ID NO: 30951 - RNA, 20 nt, Artificial Sequence
  ELANE RNA Guide
cggacucggccagcaggacc

SEQ ID NO: 30952 - RNA, 20 nt, Artificial Sequence
  ELANE RNA Guide
cgggacccggacucggccag

SEQ ID NO: 30953 - RNA, 20 nt, Artificial Sequence
  ELANE RNA Guide
cucaguggguccugcuggcc

SEQ ID NO: 30954 - RNA, 20 nt, Artificial Sequence
  ELANE RNA Guide
cucggccagcaggacccacu

SEQ ID NO: 30955 - RNA, 20 nt, Artificial Sequence
  ELANE RNA Guide
cugcuggccgaguccggguc

SEQ ID NO: 30956 - RNA, 20 nt, Artificial Sequence
  ELANE RNA Guide
cuggccgaguccgggucccg

SEQ ID NO: 30957 - RNA, 20 nt, Artificial Sequence
  ELANE RNA Guide
gacccggacucggccagcag

SEQ ID NO: 30958 - RNA, 20 nt, Artificial Sequence
  ELANE RNA Guide
gacucggccagcaggaccca

SEQ ID NO: 30959 - RNA, 20 nt, Artificial Sequence
  ELANE RNA Guide
gaguccgggucccgggggug

SEQ ID NO: 30960 - RNA, 20 nt, Artificial Sequence
  ELANE RNA Guide
gcuggccgaguccggguccc

SEQ ID NO: 30961 - RNA, 20 nt, Artificial Sequence
  ELANE RNA Guide
ggacccggacucggccagca

SEQ ID NO: 30962 - RNA, 20 nt, Artificial Sequence
  ELANE RNA Guide
ggacucggccagcaggaccc

SEQ ID NO: 30963 - RNA, 20 nt, Artificial Sequence
  ELANE RNA Guide
gggacccggacucggccagc

SEQ ID NO: 30964 - RNA, 20 nt, Artificial Sequence
  ELANE RNA Guide
ggguccugcuggccgagucc

SEQ ID NO: 30965 - RNA, 20 nt, Artificial Sequence
  ELANE RNA Guide
gguccugcuggccgaguccg

SEQ ID NO: 30966 - RNA, 20 nt, Artificial Sequence
  ELANE RNA Guide
guccugcuggccgaguccgg

SEQ ID NO: 30967 - RNA, 20 nt, Artificial Sequence
  ELANE RNA Guide
guggguccugcuggccgagu

SEQ ID NO: 30968 - RNA, 20 nt, Artificial Sequence
  ELANE RNA Guide
ucaguggguccugcuggccg

SEQ ID NO: 30969 - RNA, 20 nt, Artificial Sequence
  ELANE RNA Guide
uccugcuggccgaguccggg

SEQ ID NO: 30970 - RNA, 20 nt, Artificial Sequence
  ELANE RNA Guide
ucucaguggguccugcuggc

SEQ ID NO: 30971 - RNA, 20 nt, Artificial Sequence
  ELANE RNA Guide
ugcuggccgaguccgggucc

SEQ ID NO: 30972 - RNA, 20 nt, Artificial Sequence
  ELANE RNA Guide
uggccgaguccgggucccgg

SEQ ID NO: 30973 - RNA, 20 nt, Artificial Sequence
  ELANE RNA Guide
uggguccugcuggccgaguc

SEQ ID NO: 30974 - RNA, 20 nt, Artificial Sequence
  ELANE RNA Guide
uucucaguggguccugcugg

SEQ ID NO: 30975 - RNA, 21 nt, Artificial Sequence
  ELANE RNA Guide
acccggacucggccagcagga

SEQ ID NO: 30976 - RNA, 21 nt, Artificial Sequence
  ELANE RNA Guide
acucggccagcaggacccacu

SEQ ID NO: 30977 - RNA, 21 nt, Artificial Sequence
  ELANE RNA Guide
aguggguccugcuggccgagu

SEQ ID NO: 30978 - RNA, 21 nt, Artificial Sequence
  ELANE RNA Guide
caguggguccugcuggccgag

SEQ ID NO: 30979 - RNA, 21 nt, Artificial Sequence
  ELANE RNA Guide
cccggacucggccagcaggac

SEQ ID NO: 30980 - RNA, 21 nt, Artificial Sequence
  ELANE RNA Guide
ccggacucggccagcaggacc

SEQ ID NO: 30981 - RNA, 21 nt, Artificial Sequence
  ELANE RNA Guide
ccugcuggccgaguccggguc

SEQ ID NO: 30982 - RNA, 21 nt, Artificial Sequence
  ELANE RNA Guide
cggacucggccagcaggaccc

SEQ ID NO: 30983 - RNA, 21 nt, Artificial Sequence
  ELANE RNA Guide
cucaguggguccugcuggccg

SEQ ID NO: 30984 - RNA, 21 nt, Artificial Sequence
  ELANE RNA Guide
cucggccagcaggacccacug

SEQ ID NO: 30985 - RNA, 21 nt, Artificial Sequence
  ELANE RNA Guide
cugcuggccgaguccgggucc

SEQ ID NO: 30986 - RNA, 21 nt, Artificial Sequence
  ELANE RNA Guide
cuucucaguggguccugcugg

SEQ ID NO: 30987 - RNA, 21 nt, Artificial Sequence
  ELANE RNA Guide
gacccggacucggccagcagg

SEQ ID NO: 30988 - RNA, 21 nt, Artificial Sequence
  ELANE RNA Guide
gacucggccagcaggacccac

SEQ ID NO: 30989 - RNA, 21 nt, Artificial Sequence
  ELANE RNA Guide
ggacccggacucggccagcag

SEQ ID NO: 30990 - RNA, 21 nt, Artificial Sequence
  ELANE RNA Guide
ggacucggccagcaggaccca

SEQ ID NO: 30991 - RNA, 21 nt, Artificial Sequence
  ELANE RNA Guide
gggacccggacucggccagca

SEQ ID NO: 30992 - RNA, 21 nt, Artificial Sequence
  ELANE RNA Guide
ggguccugcuggccgaguccg

SEQ ID NO: 30993 - RNA, 21 nt, Artificial Sequence
  ELANE RNA Guide
gguccugcuggccgaguccgg

SEQ ID NO: 30994 - RNA, 21 nt, Artificial Sequence
  ELANE RNA Guide
guccugcuggccgaguccggg

SEQ ID NO: 30995 - RNA, 21 nt, Artificial Sequence
  ELANE RNA Guide
guggguccugcuggccgaguc

SEQ ID NO: 30996 - RNA, 21 nt, Artificial Sequence
  ELANE RNA Guide
ucaguggguccugcuggccga

SEQ ID NO: 30997 - RNA, 21 nt, Artificial Sequence
  ELANE RNA Guide
uccugcuggccgaguccgggu

SEQ ID NO: 30998 - RNA, 21 nt, Artificial Sequence
  ELANE RNA Guide
ucucaguggguccugcuggcc

SEQ ID NO: 30999 - RNA, 21 nt, Artificial Sequence
  ELANE RNA Guide
ugcuggccgaguccggguccc

SEQ ID NO: 31000 - RNA, 21 nt, Artificial Sequence
  ELANE RNA Guide
uggguccugcuggccgagucc

SEQ ID NO: 31001 - RNA, 21 nt, Artificial Sequence
  ELANE RNA Guide
uucucaguggguccugcuggc

SEQ ID NO: 31002 - RNA, 22 nt, Artificial Sequence
  ELANE RNA Guide
acccggacucggccagcaggac

SEQ ID NO: 31003 - RNA, 22 nt, Artificial Sequence
  ELANE RNA Guide
acucggccagcaggacccacug

SEQ ID NO: 31004 - RNA, 22 nt, Artificial Sequence
  ELANE RNA Guide
aguggguccugcuggccgaguc

SEQ ID NO: 31005 - RNA, 22 nt, Artificial Sequence
  ELANE RNA Guide
caguggguccugcuggccgagu

SEQ ID NO: 31006 - RNA, 22 nt, Artificial Sequence
  ELANE RNA Guide
cccggacucggccagcaggacc

SEQ ID NO: 31007 - RNA, 22 nt, Artificial Sequence
  ELANE RNA Guide
ccggacucggccagcaggaccc

SEQ ID NO: 31008 - RNA, 22 nt, Artificial Sequence
  ELANE RNA Guide
ccugcuggccgaguccgggucc

SEQ ID NO: 31009 - RNA, 22 nt, Artificial Sequence
  ELANE RNA Guide
ccuucucaguggguccugcugg

SEQ ID NO: 31010 - RNA, 22 nt, Artificial Sequence
  ELANE RNA Guide
cggacucggccagcaggaccca

SEQ ID NO: 31011 - RNA, 22 nt, Artificial Sequence
  ELANE RNA Guide
cgggacccggacucggccagca

SEQ ID NO: 31012 - RNA, 22 nt, Artificial Sequence
  ELANE RNA Guide
cucaguggguccugcuggccga

SEQ ID NO: 31013 - RNA, 22 nt, Artificial Sequence
  ELANE RNA Guide
cucggccagcaggacccacuga

SEQ ID NO: 31014 - RNA, 22 nt, Artificial Sequence
  ELANE RNA Guide
cugcuggccgaguccggguccc

SEQ ID NO: 31015 - RNA, 22 nt, Artificial Sequence
  ELANE RNA Guide
cuucucaguggguccugcuggc

SEQ ID NO: 31016 - RNA, 22 nt, Artificial Sequence
  ELANE RNA Guide
gacccggacucggccagcagga

SEQ ID NO: 31017 - RNA, 22 nt, Artificial Sequence
  ELANE RNA Guide
gacucggccagcaggacccacu

SEQ ID NO: 31018 - RNA, 22 nt, Artificial Sequence
  ELANE RNA Guide
ggacccggacucggccagcagg

SEQ ID NO: 31019 - RNA, 22 nt, Artificial Sequence
  ELANE RNA Guide
ggacucggccagcaggacccac

SEQ ID NO: 31020 - RNA, 22 nt, Artificial Sequence
  ELANE RNA Guide
gggacccggacucggccagcag

SEQ ID NO: 31021 - RNA, 22 nt, Artificial Sequence
  ELANE RNA Guide
ggguccugcuggccgaguccgg

SEQ ID NO: 31022 - RNA, 22 nt, Artificial Sequence
  ELANE RNA Guide
gguccugcuggccgaguccggg

SEQ ID NO: 31023 - RNA, 22 nt, Artificial Sequence
  ELANE RNA Guide
guccugcuggccgaguccgggu

SEQ ID NO: 31024 - RNA, 22 nt, Artificial Sequence
  ELANE RNA Guide
guggguccugcuggccgagucc

SEQ ID NO: 31025 - RNA, 22 nt, Artificial Sequence
  ELANE RNA Guide
ucaguggguccugcuggccgag

SEQ ID NO: 31026 - RNA, 22 nt, Artificial Sequence
  ELANE RNA Guide
uccugcuggccgaguccggguc

SEQ ID NO: 31027 - RNA, 22 nt, Artificial Sequence
  ELANE RNA Guide
ucucaguggguccugcuggccg

SEQ ID NO: 31028 - RNA, 22 nt, Artificial Sequence
  ELANE RNA Guide
ugcuggccgaguccgggucccg

SEQ ID NO: 31029 - RNA, 22 nt, Artificial Sequence
  ELANE RNA Guide
uggguccugcuggccgaguccg

SEQ ID NO: 31030 - RNA, 22 nt, Artificial Sequence
  ELANE RNA Guide
uucucaguggguccugcuggcc

SEQ ID NO: 31031 - RNA, 20 nt, Artificial Sequence
  ELANE RNA Guide
acccccgggacccggaccug

SEQ ID NO: 31032 - RNA, 20 nt, Artificial Sequence
  ELANE RNA Guide
acccggaccuggccagcagg

SEQ ID NO: 31033 - RNA, 20 nt, Artificial Sequence
  ELANE RNA Guide
accuggccagcaggacccac

SEQ ID NO: 31034 - RNA, 20 nt, Artificial Sequence
  ELANE RNA Guide
aguggguccugcuggccagg

SEQ ID NO: 31035 - RNA, 20 nt, Artificial Sequence
  ELANE RNA Guide
cacccccgggacccggaccu

SEQ ID NO: 31036 - RNA, 20 nt, Artificial Sequence
  ELANE RNA Guide
cagguccgggucccgggggu

SEQ ID NO: 31037 - RNA, 20 nt, Artificial Sequence
  ELANE RNA Guide
caguggguccugcuggccag

SEQ ID NO: 31038 - RNA, 20 nt, Artificial Sequence
  ELANE RNA Guide
cccggaccuggccagcagga

SEQ ID NO: 31039 - RNA, 20 nt, Artificial Sequence
  ELANE RNA Guide
ccggaccuggccagcaggac

SEQ ID NO: 31040 - RNA, 20 nt, Artificial Sequence
  ELANE RNA Guide
ccgggacccggaccuggcca

SEQ ID NO: 31041 - RNA, 20 nt, Artificial Sequence
  ELANE RNA Guide
ccugcuggccagguccgggu

SEQ ID NO: 31042 - RNA, 20 nt, Artificial Sequence
  ELANE RNA Guide
ccuggccagcaggacccacu

SEQ ID NO: 31043 - RNA, 20 nt, Artificial Sequence
  ELANE RNA Guide
cggaccuggccagcaggacc

SEQ ID NO: 31044 - RNA, 20 nt, Artificial Sequence
  ELANE RNA Guide
cgggacccggaccuggccag

SEQ ID NO: 31045 - RNA, 20 nt, Artificial Sequence
  ELANE RNA Guide
cugcuggccagguccggguc

SEQ ID NO: 31046 - RNA, 20 nt, Artificial Sequence
  ELANE RNA Guide
cuggccagcaggacccacug

SEQ ID NO: 31047 - RNA, 20 nt, Artificial Sequence
  ELANE RNA Guide
cuggccagguccgggucccg

SEQ ID NO: 31048 - RNA, 20 nt, Artificial Sequence
  ELANE RNA Guide
cuucucaguggguccugcug

SEQ ID NO: 31049 - RNA, 20 nt, Artificial Sequence
  ELANE RNA Guide
gacccggaccuggccagcag

SEQ ID NO: 31050 - RNA, 20 nt, Artificial Sequence
  ELANE RNA Guide
gaccuggccagcaggaccca

SEQ ID NO: 31051 - RNA, 20 nt, Artificial Sequence
  ELANE RNA Guide
gcuggccagguccggguccc

SEQ ID NO: 31052 - RNA, 20 nt, Artificial Sequence
  ELANE RNA Guide
ggacccggaccuggccagca

SEQ ID NO: 31053 - RNA, 20 nt, Artificial Sequence
  ELANE RNA Guide
ggaccuggccagcaggaccc

SEQ ID NO: 31054 - RNA, 20 nt, Artificial Sequence
  ELANE RNA Guide
gggacccggaccuggccagc

SEQ ID NO: 31055 - RNA, 20 nt, Artificial Sequence
  ELANE RNA Guide
ggguccugcuggccaggucc

SEQ ID NO: 31056 - RNA, 20 nt, Artificial Sequence
  ELANE RNA Guide
gguccugcuggccagguccg

SEQ ID NO: 31057 - RNA, 20 nt, Artificial Sequence
  ELANE RNA Guide
guccugcuggccagguccgg

SEQ ID NO: 31058 - RNA, 20 nt, Artificial Sequence
  ELANE RNA Guide
guggguccugcuggccaggu

SEQ ID NO: 31059 - RNA, 20 nt, Artificial Sequence
  ELANE RNA Guide
ucaguggguccugcuggcca

SEQ ID NO: 31060 - RNA, 20 nt, Artificial Sequence
  ELANE RNA Guide
uccugcuggccagguccggg

SEQ ID NO: 31061 - RNA, 20 nt, Artificial Sequence
  ELANE RNA Guide
ugcuggccagguccgggucc

SEQ ID NO: 31062 - RNA, 20 nt, Artificial Sequence
  ELANE RNA Guide
uggccagguccgggucccgg

SEQ ID NO: 31063 - RNA, 20 nt, Artificial Sequence
  ELANE RNA Guide
uggguccugcuggccagguc

SEQ ID NO: 31064 - RNA, 21 nt, Artificial Sequence
  ELANE RNA Guide
acccggaccuggccagcagga

SEQ ID NO: 31065 - RNA, 21 nt, Artificial Sequence
  ELANE RNA Guide
accuggccagcaggacccacu

SEQ ID NO: 31066 - RNA, 21 nt, Artificial Sequence
  ELANE RNA Guide
aguggguccugcuggccaggu

SEQ ID NO: 31067 - RNA, 21 nt, Artificial Sequence
  ELANE RNA Guide
caguggguccugcuggccagg

SEQ ID NO: 31068 - RNA, 21 nt, Artificial Sequence
  ELANE RNA Guide
cccggaccuggccagcaggac

SEQ ID NO: 31069 - RNA, 21 nt, Artificial Sequence
  ELANE RNA Guide
ccggaccuggccagcaggacc

SEQ ID NO: 31070 - RNA, 21 nt, Artificial Sequence
  ELANE RNA Guide
ccugcuggccagguccggguc

SEQ ID NO: 31071 - RNA, 21 nt, Artificial Sequence
  ELANE RNA Guide
ccuggccagcaggacccacug

SEQ ID NO: 31072 - RNA, 21 nt, Artificial Sequence
  ELANE RNA Guide
ccuucucaguggguccugcug

SEQ ID NO: 31073 - RNA, 21 nt, Artificial Sequence
  ELANE RNA Guide
cggaccuggccagcaggaccc

SEQ ID NO: 31074 - RNA, 21 nt, Artificial Sequence
  ELANE RNA Guide
cucaguggguccugcuggcca

SEQ ID NO: 31075 - RNA, 21 nt, Artificial Sequence
  ELANE RNA Guide
cugcuggccagguccgggucc

SEQ ID NO: 31076 - RNA, 21 nt, Artificial Sequence
  ELANE RNA Guide
cuggccagcaggacccacuga

SEQ ID NO: 31077 - RNA, 21 nt, Artificial Sequence
  ELANE RNA Guide
gacccggaccuggccagcagg

SEQ ID NO: 31078 - RNA, 21 nt, Artificial Sequence
  ELANE RNA Guide
gaccuggccagcaggacccac

SEQ ID NO: 31079 - RNA, 21 nt, Artificial Sequence
  ELANE RNA Guide
ggacccggaccuggccagcag

SEQ ID NO: 31080 - RNA, 21 nt, Artificial Sequence
  ELANE RNA Guide
ggaccuggccagcaggaccca

SEQ ID NO: 31081 - RNA, 21 nt, Artificial Sequence
  ELANE RNA Guide
gggacccggaccuggccagca

SEQ ID NO: 31082 - RNA, 21 nt, Artificial Sequence
  ELANE RNA Guide
ggguccugcuggccagguccg

SEQ ID NO: 31083 - RNA, 21 nt, Artificial Sequence
  ELANE RNA Guide
gguccugcuggccagguccgg

SEQ ID NO: 31084 - RNA, 21 nt, Artificial Sequence
  ELANE RNA Guide
guccugcuggccagguccggg

SEQ ID NO: 31085 - RNA, 21 nt, Artificial Sequence
  ELANE RNA Guide
guggguccugcuggccagguc

SEQ ID NO: 31086 - RNA, 21 nt, Artificial Sequence
  ELANE RNA Guide
ucaguggguccugcuggccag

SEQ ID NO: 31087 - RNA, 21 nt, Artificial Sequence
  ELANE RNA Guide
uccugcuggccagguccgggu

SEQ ID NO: 31088 - RNA, 21 nt, Artificial Sequence
  ELANE RNA Guide
ugcuggccagguccggguccc

SEQ ID NO: 31089 - RNA, 21 nt, Artificial Sequence
  ELANE RNA Guide
uggguccugcuggccaggucc

SEQ ID NO: 31090 - RNA, 22 nt, Artificial Sequence
  ELANE RNA Guide
acccggaccuggccagcaggac

SEQ ID NO: 31091 - RNA, 22 nt, Artificial Sequence
  ELANE RNA Guide
accuggccagcaggacccacug

SEQ ID NO: 31092 - RNA, 22 nt, Artificial Sequence
  ELANE RNA Guide
aguggguccugcuggccagguc

SEQ ID NO: 31093 - RNA, 22 nt, Artificial Sequence
  ELANE RNA Guide
caguggguccugcuggccaggu

SEQ ID NO: 31094 - RNA, 22 nt, Artificial Sequence
  ELANE RNA Guide
cccggaccuggccagcaggacc

SEQ ID NO: 31095 - RNA, 22 nt, Artificial Sequence
  ELANE RNA Guide
cccuucucaguggguccugcug

SEQ ID NO: 31096 - RNA, 22 nt, Artificial Sequence
  ELANE RNA Guide
ccggaccuggccagcaggaccc

SEQ ID NO: 31097 - RNA, 22 nt, Artificial Sequence
  ELANE RNA Guide
ccugcuggccagguccgggucc

SEQ ID NO: 31098 - RNA, 22 nt, Artificial Sequence
  ELANE RNA Guide
ccuggccagcaggacccacuga

SEQ ID NO: 31099 - RNA, 22 nt, Artificial Sequence
  ELANE RNA Guide
cggaccuggccagcaggaccca

SEQ ID NO: 31100 - RNA, 22 nt, Artificial Sequence
  ELANE RNA Guide
cgggacccggaccuggccagca

SEQ ID NO: 31101 - RNA, 22 nt, Artificial Sequence
  ELANE RNA Guide
cucaguggguccugcuggccag

SEQ ID NO: 31102 - RNA, 22 nt, Artificial Sequence
  ELANE RNA Guide
cugcuggccagguccggguccc

SEQ ID NO: 31103 - RNA, 22 nt, Artificial Sequence
  ELANE RNA Guide
cuggccagcaggacccacugag

SEQ ID NO: 31104 - RNA, 22 nt, Artificial Sequence
  ELANE RNA Guide
gacccggaccuggccagcagga

SEQ ID NO: 31105 - RNA, 22 nt, Artificial Sequence
  ELANE RNA Guide
gaccuggccagcaggacccacu

SEQ ID NO: 31106 - RNA, 22 nt, Artificial Sequence
  ELANE RNA Guide
ggacccggaccuggccagcagg

SEQ ID NO: 31107 - RNA, 22 nt, Artificial Sequence
  ELANE RNA Guide
ggaccuggccagcaggacccac

SEQ ID NO: 31108 - RNA, 22 nt, Artificial Sequence
  ELANE RNA Guide
gggacccggaccuggccagcag

SEQ ID NO: 31109 - RNA, 22 nt, Artificial Sequence
  ELANE RNA Guide
ggguccugcuggccagguccgg

SEQ ID NO: 31110 - RNA, 22 nt, Artificial Sequence
  ELANE RNA Guide
gguccugcuggccagguccggg

SEQ ID NO: 31111 - RNA, 22 nt, Artificial Sequence
  ELANE RNA Guide
guccugcuggccagguccgggu

SEQ ID NO: 31112 - RNA, 22 nt, Artificial Sequence
  ELANE RNA Guide
guggguccugcuggccaggucc

SEQ ID NO: 31113 - RNA, 22 nt, Artificial Sequence
  ELANE RNA Guide
ucaguggguccugcuggccagg

SEQ ID NO: 31114 - RNA, 22 nt, Artificial Sequence
  ELANE RNA Guide
uccugcuggccagguccggguc

SEQ ID NO: 31115 - RNA, 22 nt, Artificial Sequence
  ELANE RNA Guide
ucucaguggguccugcuggcca

SEQ ID NO: 31116 - RNA, 22 nt, Artificial Sequence
  ELANE RNA Guide
ugcuggccagguccgggucccg

SEQ ID NO: 31117 - RNA, 22 nt, Artificial Sequence
  ELANE RNA Guide
uggguccugcuggccagguccg

SEQ ID NO: 31118 - RNA, 20 nt, Artificial Sequence
  Example Guide RNA
aaaaaaaccagacgccggcc

SEQ ID NO: 31119 - RNA, 17 nt, Artificial Sequence
  17 nucleotide guide sequence 1
aaaaccagacgccggcc

SEQ ID NO: 31120 - RNA, 17 nt, Artificial Sequence
  17 nucleotide guide sequence 2
aaaaaccagacgccggc

SEQ ID NO: 31121 - RNA, 17 nt, Artificial Sequence
  17 nucleotide guide sequence 3
aaaaaaccagacgccgg

SEQ ID NO: 31122 - RNA, 17 nt, Artificial Sequence
  17 nucleotide guide sequence 4
aaaaaaaccagacgccg

SEQ ID NO: 31123 - protein, 1100 aa, Butyrivibrio sp. AC2005
MGYTIGLDLGVASLGWAVVNDEYEVLESCSNIFPAAESANNVERRGFRQGRRLSRRRRTRISDFRKLWEKSGFEVPSNELNEVLQYRIKGMNDKLSEDELYHVLLNSLKHRGISYLDDADDENASGDYAASIAYNENQLKTKLPCEIQWERYKKYGAYRGNITIQEGGEPLTLRNVFTTSAYEKEIQKLLDVQSMSNEKVTKKFIDEYLKIFSRKREYYIGPGNKKSRTDYGVYTTQKNEDGTYHTEQNLFDKLIGKCSVYPDERRAAGATYTAQEFNLLNDLNNLVIDGRKLDEQEKCQIVDAVKHAKTVNMKNIIAKVIGTKANSMNMTGARIDKNEKEIFHSFEAYNKLRKALEEIDFDIETLSTDELDAIGEVLTLNTDRKSIQNGLQEKRIVVPDEVRDVLIATRKRNGSLFSKWQSFGIRIMKELIPELYAQPKNQMQLLTDMGVFKTKDERFVEYDKIPSDLITEEIYNPVVAKTVRITVRVLNALIKKYGYPDRVVIEMPRDKNSEEEKKRIADFQKNNENELGGIIKKVKSEYGIEITDADFKNHSKLGLKLRLWNEQNETCPYSGKHIKIDDLLNNPNMFEVDHIIPLSISFDDSRANKVLVYAAENQNKGNRTPMAYLSNVNREWDFHEYMSFVLSNYKGTIYGKKRDNLLFSEDIYKIDVLQGFISRNINDTRYASKVILNSLQSFFGSKECDTKVKVVRGTFTHQMRMNLKIEKNREESYVHHAVDAMLIAFSQMGYDAYHKLTEKYIDYEHGEFVDQKGYEKLIENDVAYRETTYQNKWMTIKKNIEIAAEKNKYWYQVNRKSNRGLCNQTIYGTRNLDGKTVKISKLDIRTDDGIKKFKGIVEKGKLERFLMYRNDPKTFEWLLQIYKDYSDSKNPFVQYESETGDVIKKVSKTNNGPKVCELRYEDGEVGSCIDISHKYGYKKGSKKVILDSLNPYRMDVYYNTKDNRYYFVGVKYSDIKCQGDSYVIDEDKYAAALVQEKIVPEGKGRSDLTELGYEFKLSFYKNEIIEYEKDGEIYVERFLSRTMPKVSNYIETKPLEAAKFEKRNLVGLAKTSRIRKIRVDILGNRYLNSMENFDFVVGHK

SEQ ID NO: 31124 - protein, 1170 aa, Aliiarcobacter faecis
MERILGLDLGTNSIGFALNKVEEKDSITIFNELASNSIIFSEYVPSTDRRAFRSGRRRNERASRRKENIRKLFCYFNLASKNILDNPIEYFNNLTKLYKEPYSLREEAIKGKKLSKDEFTFALYTIISRRGYTNLFAKEEDENKAKESEKINSAILNNKNIYKNSNYTLPSKVLTLKKEELEEDGFINIAIRNKKDNYNNSLDRKLWQEEAELLIESQKNNIELFKDIKTYEDFKNKFINGVNKNSKGIFEQRNLKSVEDMVGFCSFYNLYSKEPQKRVINAHIKAIEFVLRQRIENSILGNLILNKKTGEFVKISKEDIETTINFWLYTPNVQTITAKNIFKNAGLKDLEIQTSDKQDDTVQDISVHKALLEIVDFETILKNEEFYSKLLEVLHYFVSEQQIKDEIKKLNKENILSEEQIDKIANINKAKSSYLSFSLKFIDEILQKLKNDISYQTCLEELGYFKRYTQMEAYNYLPPLNPSIEDIKWLEKNVKNFKSEQLFYQPLISPNVKRVISILRRLVNELISKYGKIDKIIIETARELNSKKDEDKIKKSQEQSNKEIKDAQTLLKSGNKELSNKNILRARLLKEQKSKCLYSGEGLTLEEALDENITEIEHFIPRSKIWIDSYKNKILVLKKYNQNKSNQHPVSFLKSIGKWENFVGRVDEFIANKDKKICLTDEKNIQKIWDNEKLEDRFLNDTRSATKIVANYLEHYLFPKQNEYGKGESNDKVIRVTGKAINELKKLWGINEAQPKNEEGKKDRDTNYHHTIDAIVISLLNNSSKKALNDFFKQKEDKFKTKAILEKLKTRFPISKNGKSLFEFVKDKVEKYEKNELYVCPYMKKRENIRGFKDGNIKLIWDKELNNFSQIDKVEINKKLLLNNFGKDLKDDEVKKEFEKIKDKLNLPKQNNIKIALEEYEKRLLEIRKKINNISEEIKQEQNNLPRDKKAIETVEILEIKNRIEKLEQTKKEFVKELEFPCFFYTKDGKKQIVRSLNLKSNSVTKADSIIITDKKQKNRVQRLTKEVYENLKSSKTPFVAKLNDNTLSVDLYNTLKGQLIGLNYFSSIKNDILPKIDERKIKLISNYDDKITVSKNNIIEIEDLKNGTKNYYTCNGGGEIGKGKNVIKVDNINTKNKSVIPIQIADYRIVKPVKINFFGKISYEEFKKN

SEQ ID NO: 31125 - protein, 1370 aa, Ezakiella peruensis strain M6.X2
MTKVKDYYIGLDIGTSSVGWAVTDEAYNVLKFNSKKMWGVRLFDDAKTAEERRGQRGARRRLDRKKERLSLLQDFFAEEVAKVDPNFFLRLDNSDLYMEDKDQKLKSKYTLFNDKDFKDKNFHKKYPTIHHLLMDLIEDDSKKDIRLVYLACHYLLKNRGHFIFEGQKFDTKSSFENSLNELKVHLNDEYGLDLEFDNENLINILTDPKLNKTAKKKELKSVIGDTKFLKAVSAIMIGSSQKLVDLFENPEDFDDSAIKSVDFSTTSFDDKYSDYELALGDKIALVNILKEIYDSSILENLLKEADKSKDGNKYISNAFVKKYNKHGQDLKEFKRLVRQYHKSAYFDIFRSEKVNDNYVSYTKSSISNNKRVKANKFTDQEAFYKFAKKHLETIKYKINKVNGSKADLELIDGMLRDMEFKNFMPKIKSSDNGVIPYQLKLMELNKILENQSKHHEFLNVSDEYGSVCDKIASIMEFRIPYYVGPLNPNSKYAWIKKQKDSEITPWNFKDVVDLDSSREEFIDSLIGRCTYLKDEKVLPKASLLYNEYMVLNELNNLKLNDLPITEEMKKKIFDQLFKTRKKVTLKAVANLLKKEFNINGEILLSGTDGDFKQGLNSYNDFKAIVGDKVDSDDYRDKIEEIIKLIVLYGDDKSYLQKKIKAGYGKYFTDSEIKKMAGLNYKDWGRLSKKLLTGLEGANKITGERGSIIHFMREYNLNLMELMSASFTFTEEIQKLNPVDDRKLSYEMVDELYLSPSVKRMLWQSLRIVDEIKNIMGTDSKKIFIEMARGKEEVKARKESRKNQLLKFYKDGKKAFISEIGEERYSYLLSEIEGEEENKFRWDNLYLYYTQLGRCMYSLEPIDISELSSKNIYDQDHIYPKSKIYDDSIENRVLVKKDLNSKKGNSYPIPDEILNKNCYAYWKILYDKGLIGQKKYTRLTRRTGFTDDELVQFISRQIVETRQATKETANLLKTICKNSEIVYSKAENASRFRQEFDIVKCRAVNDLHHMHDAYINIIVGNVYNTKFTKDPMNFVKKQEKARSYNLENMFKYDVKRGGYTAWIADDEKGTVKNASIKRIRKELEGTNYRFTRMNYIESGALFNATLQRKNKGSRPLKDKGPKSSIEKYGGYTNINKACFAVLDIKSKNKIERKLMPVEREIYAKQKNDKKLSDEIFSKYLKDRFGIEDYRVVYPVVKMRTLLKIDGSYYFITGGSDKTLELRSALQLILPKKNEWAIKQIDKSSENDYLTIERIQDLTEELVYNTFDIIVNKFKTSVFKKSFLNLFQDDKIENIDFKFKSMDFKEKCKTLLMLVKAIRASGVRQDLKSIDLKSDYGRLSSKTNNIGNYQEFKIINQSITGLFENEVDLLKL

SEQ ID NO: 31126 - protein, 1369 aa, Clostridium sp. AF02-29
MKEKMEYYLGLDMGTNSVGWAVTDKEYRLMRAKGKDLWGVRLFERANTAEERRAYRINRRRRQREVARIGILKELFADEIAKVDANFFARLDDSKYYLDDRQENNKQKYAIFADKDYTDKEYFSQYQTIFHLRKELILSDQPHDVRLIYLALLNMFKHRGHFLNKTLGTSESLESFFDMYQRLAVCADGEGIKLPETVDLKKLEQILGARGCSRKATLEHISEIMGINKKNKPVYSLMQMICGLDTKMIDLFGQKIDEEHKKISLSFRTSNYEEMAEEVRNTIGDDAFELILTAKEMHDFGLLAEIMKGYSYLSEARVAVYEEHRKDLAKLKAVFKQYDHKAYDEMFRIMKNGTYSAYVGSVNSFGKIERRTVKTSREELLKNIKKILTGFPEDDATVQEFLGKIDSDTLLQKQLTASNGVIPNQVHAKEMKVILKNAEKYLPFLSERDETGLSVSEKIIALFTFTIPYYVGPLGQQHLGKECAHGWVERKEKGTVYPWNFEQKVDLKASAEHFIERMVKHCTYLSDEQALPKQSLLYEKFQVLNELNNLKIRGEKISVELKQQIYRDVFEHTGKKVSMKQLENYLKLNGLLEKDEKDAVTGIDGGFHSYLSSLGKFIGILGEEAHYGKNQNMMEKIVFWGTVYGQDKKFLRERLSEVYGDRLSKEQIRRITGMKFEGWGRLSKEFLLLEGASREEGEIRTLIRSLWETNENLMGLLSERYTYSEEVREKTLECEKSLSEWTIEDLEGMYLSAPVKRMVWQTLLIVKELEKVLGCAPRRIFVEMAREDAEKGRRTESRKQKLQNLYKAIKKEEIDWKKEIDEKTEQAFRSKKLYLYYLQKGRCMYTGESIRFEDLMNDNLYDIDHIYPRHFVKDDSLEQNLVLVKKEKNAHKSDVFPIEADIQKKMSPFWKELKERGFISEEKYMRLTRRYGFSEEEKAGFINRQLVETRQGTKSITEILGQAFPDVDIIFSKASNVSEFRHIYGLYKVRSINDFHHAHDAYLNIVVGNTYHVKFTKNPLNFIREAEKNPQNAENKYNMNRMFDWTVKRGNETAWIASSDKEAGSIKIVKAILAKNTPLVTKRCAEAHGGITRKATIWNKNKAAGSGYIPVKMNDARLLDVTKYGGLTSVSASGYTLLEYDVKGKKIRSLEAIPIYLGRVSELTNEAILKYFEKVLIEENKGKEITELRICKKFIPRESLVRYNGYYYYLGGKSVEQIVLKNATQMAYSEEETCYIKKIEKAIEKTYYEEVDKNKNVILTKTRNNAMYDKFIIKYQNSIYQNQSGAMKNSIIGKRNEFLTLSLEKQCRILKALVEYFRTGDIIDLRELGGSSQAGKVAMNKKIMGASELVLISQSPTGLFQQEIDLLKI

SEQ ID NO: 31127 - DNA, 3303 bp, Butyrivibrio sp. AC2005
atgggatatacaataggacttgatcttggtgtggcttcattaggatgggctgtagtcaatgatgaatatgaggtattagaatcatgctcaaatatttttcctgcagcagaatctgcaaataatgttgaaagacgaggctttaggcagggaagaaggttgtcaaggcgtcgcaggaccagaattagtgatttcagaaaactgtgggagaagagtggtttcgaggttccttcaaatgaattgaacgaggtgcttcagtataggattaaaggcatgaatgataaattatcagaagatgagctttatcatgttcttttaaatagcctgaaacataggggaatttcgtatttggatgatgcagatgatgaaaatgcatctggggattatgctgcaagcattgcttataacgaaaatcaattaaagacaaaattgccttgtgagattcagtgggagcgctataagaaatatggtgcttatagggggaatattactatccaagaaggtggggaaccgcttactcttagaaatgtattcacaacaagtgcgtatgaaaaagaaattcagaagctattagacgtacaatctatgtcaaatgagaaagtaacaaaaaagtttattgatgaatacttaaaaatcttttcaagaaaaagagaatattatattgggccgggtaacaaaaaatccagaacagattatggtgtatacactacacaaaaaaatgaagatggtacttatcatactgagcagaatctttttgataaattgattggaaagtgtagtgtatatcctgatgagagaagagctgccggggctacttatactgcacaggaatttaatcttttaaatgatctgaataatcttgtaattgatggaagaaaactagatgagcaggaaaaatgtcagattgttgatgctgttaaacatgctaaaaccgtcaatatgaagaacattattgcaaaagtcattggaacaaaagcaaactcaatgaatatgaccggcgcaagaatagataagaatgaaaaagaaatttttcattcttttgaggcttataacaagttaagaaaagcactggaagaaatagattttgatatagagactttgtctacggatgagttggatgctataggagaagtgttgactcttaatactgaccgaaaatcaattcaaaacggacttcaagagaaaagaatagtagttcctgatgaagtcagggatgtgcttatcgcaaccaggaaaagaaatggctcattatttagcaaatggcagtcatttggtataagaatcatgaaggaattgattcctgaattatatgcgcagcctaagaatcagatgcaactgcttactgatatgggagtatttaaaactaaggatgagagatttgttgagtatgataagattccgtctgatctaataacagaagaaatctataatcctgtggttgctaaaactgtaaggattactgtcagagttttgaatgctcttattaagaaatatggctatccggatagagttgttatagagatgccaagagataaaaactcagaagaagagaaaaagcgcatagcagattttcaaaagaacaatgagaatgagcttggtggaataataaaaaaagtaaagtcagaatatggtattgaaataactgatgcggattttaagaaccatagtaaacttggacttaaacttaggttgtggaatgaacagaatgaaacatgtccttactcagggaaacatataaagattgatgaccttttaaataatcctaatatgtttgaggtggatcatattatcccattatccatttcatttgatgatagtagagccaataaagtgttggtatacgctgctgaaaatcagaataagggtaacagaacgccaatggcatacctgtccaatgttaatagagaatgggatttccatgaatacatgagttttgttcttagtaattataagggaacaatatatggtaagaagagagataatcttttattctcagaggacatatataaaattgatgttttacagggatttattagcagaaatataaatgatacaagatatgcttcaaaggtaatacttaattcattacagtctttctttggttcaaaagagtgcgacacgaaggtgaaggttgttagaggaacctttacacatcagatgcgaatgaatctaaagatagaaaagaatagagaggagtcatatgtgcatcatgctgttgatgctatgcttatagctttttctcaaatggggtatgatgcatatcataaacttacagagaagtatattgattatgaacatggcgaatttgtagatcagaaaggctatgagaagcttattgaaaatgatgtagcatatcgtgaaaccacttatcaaaataagtggatgactataaagaaaaatatagaaatagcagctgaaaagaataaatactggtatcaggtaaataggaaaagcaatagagggctttgcaaccagactatttatggtaccagaaatctggatggcaagacagtaaagatcagcaaacttgatattcggacagatgatgggataaagaaatttaaagggatcgtagaaaaaggtaaactagaacgctttttgatgtataggaatgatccaaaaacatttgaatggctgcttcagatttataaggattattcagactccaaaaacccatttgtccaatatgaatcagagactggtgatgttattaagaaagtttcaaaaacgaataatggaccaaaggtatgtgaacttcgctatgaagatggtgaggttggtagctgtatcgatatttctcataagtatggatataaaaagggtagtaaaaaggtaattctcgattctttaaacccttacagaatggatgtatattataacactaaggacaataggtattattttgttggtgtaaagtattcagacattaagtgccaaggtgatagctatgtaatcgatgaggataaatacgcagcagcactcgttcaggaaaaaatagtgccggaaggaaaaggaagaagtgacttaacagagcttggttatgaatttaagctatcattttataaaaatgagataatagagtatgaaaaagatggcgaaatatatgtagaaagatttttatcgcgaacaatgccaaaagtgagcaattatattgaaactaagccattggaagctgcaaaatttgaaaaacgaaatttagtggggttagctaagactagcagaataagaaaaatacgagtggatatacttgggaatcgttatttaaatagtatggaaaatttcgattttgttgtgggacataaataa

SEQ ID NO: 31128 - DNA, 3297 bp, Artificial Sequence
  Human optimized OMNI39 seq
gggtacaccattggcttggatttgggagtggcttcattgggttgggcagtcgtgaacgacgagtacgaagtgctcgagtcttgtagcaacatcttccccgccgccgagtccgctaacaacgtcgagcgaagagggttccgccaaggcaggcggttgtctcggcgcaggcgcactcgtataagcgattttcgtaagctttgggaaaagagcggatttgaagtgcccagtaacgagctgaatgaagttctccaataccggatcaaggggatgaacgacaagctgagtgaggacgaattgtaccacgtgctgttgaactcattgaagcaccggggtatcagctacctggacgacgccgacgacgagaacgcctcaggtgactacgccgcctctatcgcgtacaatgagaaccagttgaaaaccaagctcccctgcgaaatccaatgggaaaggtacaagaagtacggggcgtaccgcggtaacatcaccatacaggagggaggcgagccactgactctccgaaacgtgtttacgacgtctgcttacgagaaggagatccagaaactcttggatgtgcagagtatgagtaacgaaaaggtcacgaagaaattcatcgacgagtatctgaagattttcagtcgcaagagggagtactacataggtccaggcaataagaagtcacgaaccgactacggcgtttataccactcagaagaacgaggacggcacctaccacacagaacaaaacctgttcgacaagcttatcggtaaatgctccgtttaccccgacgaaaggcgcgcagcgggtgccacatacacagcccaagagttcaacttgctgaacgacttgaacaacctcgttatcgacggcaggaagctggacgaacaagagaagtgccaaatcgtcgacgcggtgaagcacgccaagacggttaacatgaagaatatcatcgccaaggtaatcggtactaaggcgaatagtatgaacatgacaggggctaggattgacaagaacgagaaggagatcttccacagtttcgaagcgtacaataaactgaggaaggctctcgaggagattgacttcgacattgaaaccctcagtaccgacgaacttgacgccatcggggaagtcctgacactgaacaccgatagaaagagcatccagaatgggttgcaggaaaagcggatcgtggtccccgacgaggtaagagatgtactgattgccactcgtaagcgtaacgggagcctgttctccaagtggcaatctttcggaatccgtattatgaaagagctcatcccggagctgtacgcccaaccaaagaaccaaatgcagttgctgaccgacatgggcgtcttcaagaccaaagacgaacggttcgtggaatacgacaaaatccccagtgacctcatcacggaagagatatacaaccccgttgtcgccaagaccgtccgcatcaccgttcgcgtccttaacgcgctcatcaagaagtacgggtatcccgacagggtggtgatcgaaatgcctcgtgacaagaatagtgaggaagaaaagaaaaggattgctgacttccagaagaataacgaaaacgaactgggcggcatcatcaagaaggtcaaaagtgagtacggcatcgagatcaccgacgcagacttcaagaatcacagcaagttgggtctcaagctgcgactctggaacgagcaaaacgagacttgtccctatagcggcaagcacattaaaatcgacgatctgttgaacaacccgaacatgttcgaagtagaccacatcattcccctctcaatctccttcgacgactctcgcgctaacaaggtcctggtgtatgcagcagagaaccaaaacaaaggaaataggactcccatggcttatttgagtaacgtcaaccgcgagtgggactttcacgagtatatgtctttcgtgctgtcaaactacaaaggcactatctacgggaagaaacgggacaacctcttgttttccgaagatatctacaagatagacgtgctgcaagggttcatctcccggaacatcaacgacacccgatacgcgagtaaagtgattctgaacagcctgcaaagtttcttcgggtctaaggaatgtgataccaaagtcaaagtggtacggggcactttcacgcaccaaatgagaatgaacttgaaaattgagaagaaccgggaagaaagttacgtccaccacgcagtcgacgcaatgctgattgccttcagccagatgggctacgacgcctaccacaagctcaccgagaaatacatagactacgagcacggagagttcgtggaccaaaagggatacgaaaagctgatcgagaacgacgtcgcctacagggaaacgacctaccagaacaaatggatgacaatcaagaagaacattgagatcgctgccgagaagaacaagtattggtatcaagtgaaccggaagtcaaacaggggactgtgtaatcaaaccatctacggcactcgtaaccttgacgggaaaaccgtgaaaatttctaagctcgacatccgcactgacgacggaatcaagaagttcaagggtattgttgagaagggcaagcttgagagattccttatgtaccgtaacgaccctaagaccttcgagtggctcctgcaaatctacaaagactactctgatagcaagaatcccttcgtgcagtacgagtccgaaacaggtgacgtgataaagaaggtaagcaagacaaacaacggccccaaagtctgcgagctgcgatacgaggacggggaagtgggaagttgcattgacatatcccacaaatacgggtacaagaaaggcagcaagaaagtgatcctggacagcctgaatccctatcgcatggacgtgtactacaataccaaagataacagatactacttcgtgggcgttaaatactctgatatcaaatgtcagggagactcttacgtgattgacgaagacaagtatgctgctgccctggtacaagagaagatcgtacctgaggggaaggggcgcagcgatctcactgaactgggctacgagttcaaactgtctttctacaagaacgaaattattgaatacgagaaggacggggagatctacgtcgagcgcttcctgtcaaggaccatgcccaaggtctccaactacatcgagacaaaaccccttgaggccgctaagttcgagaagcggaacctggtaggattggccaaaacatcaaggattcgaaagattagagtcgacattctcggcaacaggtatctgaactcaatggagaactttgacttcgtcgttggtcacaag

SEQ ID NO: 31129 - DNA, 3513 bp, Aliiarcobacter faecis
atggaaagaattttagggttagatttaggtacaaatagcataggatttgcactaaataaagtagaagagaaagatagtattacaatttttaatgaactagcttcaaatagtataatttttagtgaatatgttccatctactgatagaagagcttttagaagcggaagacgaagaaatgaaagagctagtagaagaaaagagaatattagaaaacttttttgctattttaatctagcttcaaaaaatatattagataatccaatagagtattttaataatcttacgaaactttacaaagagccatatagtttaagagaagaagcaataaaaggtaaaaaattatcaaaagatgagtttacatttgctctttatacaataatctcaagaagaggatatacaaatctttttgcaaaagaagaagatgaaaacaaagcaaaagagagtgaaaagataaatagtgcgattttaaataataaaaatatttataaaaatagtaactatacacttccttcaaaagttttaacactgaaaaaagaagaattagaggaagatggttttataaatattgcgataagaaataagaaagataattataataattcacttgatagaaaactttggcaagaagaagcagaacttttaatagagagtcaaaaaaataatatagaactttttaaagatataaaaacttatgaggatttcaaaaataagtttataaatggtgtaaataaaaattcaaaaggaatttttgaacaaagaaatttaaaaagtgttgaagatatggtaggtttttgtagcttttataacttatattcaaaagagcctcaaaaaagagttataaatgcacatataaaagctattgaatttgttttaagacaaagaattgaaaactctattttaggaaatttgattttaaacaaaaaaactggtgagtttgtaaaaatctcaaaagaagatatagaaactactattaatttttggctatatactcccaatgtacaaacaataactgctaaaaatatcttcaaaaatgctggacttaaagatttagagatacaaacttcagataaacaagatgatacagttcaagatatatctgtacataaagcacttttagagatagttgattttgaaactattttgaaaaatgaagaattttactcaaaacttttggaagttttacactattttgtaagtgagcaacagataaaagatgagattaaaaagctaaataaagagaatattttaagtgaagaacaaatagataaaatagcaaatataaacaaagctaaaagctcttatttatcattttctttaaaatttatagatgagattttacaaaagttgaaaaatgatatatcttaccaaacatgccttgaagagttaggatattttaaaagatatactcaaatggaagcttataattatcttccaccactaaatcctagtattgaagatataaaatggctagaaaaaaatgttaaaaattttaaatcagaacaactattttatcaaccacttattagtccaaatgtaaaaagagtaatctcaattttaagaagattggtaaatgagctaatatcaaaatacggaaaaatagataaaatcataattgaaacagcaagagaactaaactcaaaaaaagatgaagataaaatcaaaaaatcacaagaacaaagcaataaagagataaaagatgcccaaactttactaaaaagtggaaataaagagttaagtaataaaaatattttaagggcaagacttttgaaagaacaaaaatcaaaatgcctttatagtggagagggtttaactcttgaggaagctttagatgaaaatataacagagattgagcattttatccctagaagtaaaatttggatagatagttataaaaataaaatattggtacttaaaaaatacaatcaaaataaatcaaaccaacacccagtaagctttttgaaatctattggtaagtgggaaaattttgtaggtcgtgtagatgagtttatagcaaataaagataaaaaaatttgcctaacagatgaaaaaaatatccaaaaaatttgggataatgaaaaattagaagatagatttctaaacgatacaagaagtgctacaaaaatagttgcaaactatttagaacactatttatttccaaaacaaaatgagtatggaaaaggtgaatcaaacgataaagtaataagagtcacagggaaagctataaatgaactaaaaaaactttggggaataaatgaagcacaaccaaagaacgaagagggtaaaaaggatagagatacaaactatcatcatacaatagatgctattgttatttcacttttaaataactcttcaaaaaaggctttaaatgactttttcaaacaaaaagaggataaatttaaaacaaaagctattttagaaaaattaaaaacaagattcccaatttcaaaaaatggcaaatctttatttgaatttgtaaaagataaagtagagaaatatgagaaaaatgaactatatgtttgcccttatatgaaaaaaagagaaaatattcgtggttttaaagatggaaatataaaacttatttgggataaagagctaaataacttctctcaaatagataaagtagagattaataaaaaattactcttaaataattttggaaaagatttaaaagatgatgaagttaaaaaagagtttgaaaaaataaaagataagctaaatcttccaaaacaaaacaatataaaaatagctttagaagagtatgagaaaagactactagaaataagaaaaaaaataaataatataagtgaagagataaaacaagaacaaaataatcttccaagagataaaaaagctattgaaacagttgaaattttggaaataaaaaatagaatagaaaaattggaacagactaaaaaagagtttgtaaaagagctagaatttccttgtttcttctatacaaaagatggtaaaaaacagatagttagaagcttaaatctaaaatcaaactctgtaacaaaagctgatagtataataatcacagataaaaagcaaaaaaatagagtacaaagattaacaaaagaagtttatgaaaatttaaaatcttctaaaacaccttttgtagcaaaattaaatgataacaccttgagtgtagatttatataacactttaaaaggacaattaataggtctaaactatttttcttctataaaaaatgatattttgccgaaaattgatgaaagaaagataaaattaatatcaaattacgatgataaaataactgtatcaaaaaataatattatagaaattgaagatttaaaaaatggtacaaagaattattatacttgtaatggtggtggagaaataggtaaaggaaaaaatgttattaaagtagataacataaatacaaaaaataaatcagtaattcctattcaaatagctgattatagaattgtaaaaccagtaaaaataaatttctttggaaagatttcttatgaagagtttaagaaaaattaa

SEQ ID NO: 31130 - DNA, 3507 bp, Artificial Sequence
  Human optimized OMNI40 seq
gaacggatactcggattggacctgggaacgaactccattggcttcgcccttaacaaggtggaagaaaaggactctatcactatattcaacgagcttgcctctaactctattatcttcagcgagtacgtccctagcacagaccgtcgggcattccggtctggccgtcgcaggaacgagagggccagccgccggaaggaaaacatccgtaagctcttctgttacttcaaccttgcatctaagaacatcctcgacaaccccatcgaatacttcaacaacctgactaagctgtataaggaaccttactccttgcgggaagaggccatcaaggggaagaagctgtctaaggacgaatttaccttcgcactgtacaccatcatttctcgtcggggctacactaacctcttcgccaaggaagaggacgagaataaggccaaggaatccgagaaaattaactctgcaatcctgaacaacaagaacatctacaagaacagcaattacactctgccgagtaaggtcctgactttgaagaaggaagagctggaagaggacgggttcattaacatcgctatccgcaacaagaaggacaactacaacaactccctggaccggaagctctggcaggaagaggccgagcttcttattgaaagccagaagaacaacatcgagctcttcaaggacatcaagacatacgaagactttaagaacaaattcatcaacggagttaacaagaactccaagggcatattcgagcagaggaacctgaagagcgttgaggacatggtgggattctgctcattctacaatttgtacagcaaggaaccgcagaagcgcgtcatcaacgcccacattaaggccatagagttcgtgctgcgacagcgcatcgagaactcaatcctcggcaaccttatcctcaataagaagaccggcgaatttgtgaagatatctaaggaagacatcgagacaaccatcaacttctggttgtacaccccaaacgtgcagaccatcaccgcaaagaacatctttaagaacgcgggcctcaaggacctggaaatccagaccagcgacaagcaggacgacaccgtgcaggacatttccgtgcacaaggccctgctggaaatcgtcgacttcgagaccatactcaagaacgaggagttctatagtaagctgctcgaggtattgcattacttcgtgtcagaacagcaaatcaaggacgaaatcaagaaactcaacaaggaaaacatcctcagcgaggagcagattgacaagatcgccaacatcaataaggccaagtcctcatacctgtctttctccctcaagttcattgacgaaatacttcagaaactgaagaacgacattagttatcagacctgtctcgaggaactgggttacttcaagcgctacacccagatggaagcatacaactacctgccacctctcaacccatcaatcgaggacatcaagtggctggagaagaacgtgaagaacttcaagagtgagcagctgttctaccagcccctcatctcccccaacgtgaagcgggtcataagtatcctgcgccggctggtcaacgaattgatctccaagtatggcaagattgacaagattattatcgagactgcccgcgagctcaattctaagaaggacgaggacaagataaagaagtcccaggagcagagtaacaaggaaatcaaggacgctcagacactcctgaagtcagggaacaaggaactgagcaacaagaacatacttcgcgctcggttgctcaaggagcagaagtctaagtgtctgtactccggggaaggacttaccctggaagaggcactcgacgagaacattactgaaatcgaacacttcataccacggagcaagatctggatcgactcatacaagaacaagattctggtgctgaagaagtataaccagaacaagagcaatcagcatcccgttagtttcctgaagtccatcggcaaatgggagaacttcgtgggcagggtcgacgaatttatcgccaacaaggacaagaagatctgtctgacggacgagaagaacattcagaagatatgggacaacgagaagcttgaggaccgtttcctgaatgacacccgatctgcaaccaagatcgtcgccaattacctcgagcattacctcttcccgaagcagaacgaatacggtaagggcgagtccaatgacaaggttattagggtgaccggtaaggccatcaacgagcttaagaagctgtggggcatcaacgaggctcagcctaagaatgaggaagggaagaaagaccgggacactaattaccaccacaccatcgacgccatcgtgatatccctgctgaacaatagttccaagaaagccttgaacgatttctttaagcagaaggaagacaagttcaagaccaaggcgatactcgagaagttgaagacccggtttcccatctctaagaacggaaagtcactgttcgagttcgttaaggacaaggttgaaaagtacgaaaagaacgagttgtacgtgtgtccatacatgaagaagcgggagaacatacgcggattcaaggacggcaacatcaagctgatctgggacaaggaattgaacaattttagccagatcgacaaggtggaaataaacaagaagcttctgctgaacaacttcggcaaggacctgaaggacgacgaggtgaagaaggaatttgagaagatcaaggacaaactgaaccttccgaagcagaataacatcaagattgcgctcgaggaatacgaaaagcggctgctggagatccggaagaagatcaacaacatttccgaggaaatcaagcaggagcagaacaacctgcctagggacaagaaggccatcgagaccgtagagatcctcgagatcaagaaccgtattgagaagctcgagcaaaccaagaaggagttcgtgaaggaactggagttcccatgcttcttttacactaaggacggaaagaagcaaatcgtgaggtctctcaacctcaagtctaattcagtcacgaaggcagactcaatcatcattactgacaagaaacagaagaaccgggtgcagcgcctgaccaaagaggtctacgagaaccttaagagcagtaagactcccttcgtggcgaagctgaacgacaatacgctgagcgtggacctgtacaatacacttaaggggcagctcattgggctgaattacttctcaagcattaagaacgacatcctgcccaagatcgacgagcgtaaaattaagctgatcagtaactatgacgacaagatcaccgtttccaagaacaacatcattgagatcgaggaccttaagaacggaactaagaactactacacctgcaacggcggcggggagattggaaagggcaagaacgtgatcaaggtggacaatatcaacaccaagaacaagtctgtgataccaatccagattgccgactaccgcatcgtgaagccggtgaagattaacttcttcggcaaaatcagctacgaggagttcaagaagaac

SEQ ID NO: 31131 - DNA, 4113 bp, Ezakiella peruensis strain M6.X2
atgacaaaagtaaaagattattatatcggacttgatataggtacatcatcagttggctgggcagtaacagacgaggcttacaatgttctaaaattcaactccaagaagatgtggggagttcgtctttttgatgatgccaaaactgctgaagaaagacgagggcaaagaggggccaggagaagacttgaccgcaaaaaagaacgcttaagtctcttgcaagatttttttgcagaggaagttgctaaagtagatccaaatttctttttgcgtctagataacagcgacctttatatggaggacaaagatcaaaagttaaagtccaagtacactttatttaatgataaagattttaaagacaagaacttccacaaaaaatatccgactatccaccatctccttatggacttgattgaagatgatagcaaaaaagatattagactggtttatttagcttgccattacttacttaaaaatcgtggccactttatttttgaaggacaaaaatttgatacaaagagctcctttgaaaattctctaaatgaattaaaggtccacttaaatgatgaatacggtcttgatcttgagtttgataatgaaaatttgataaatatacttacagatcctaagttaaacaagaccgcaaaaaagaaagaacttaaaagtgttattggagatacaaaatttctaaaggcagtatctgctattatgattggtagctctcaaaagctagtagatctatttgaaaatcctgaagactttgatgattcggcaatcaaatcagtggatttttctacgacgagttttgatgataaatatagcgattacgagttagcccttggggataaaattgcccttgtaaatatattaaaagaaatctatgactcatctatacttgaaaatttattaaaagaagccgataaatcaaaagatggcaataagtacatttctaacgcctttgtaaaaaaatataacaagcatggccaggacctcaaggaatttaagcgcctagttagacagtaccataaatcagcctacttcgacatctttaggagtgaaaaagtaaacgataactatgtttcatataccaagtcaagtatatccaataacaagagagtgaaggcgaataagtttacagaccaagaagctttttataagtttgctaaaaagcacctagaaactataaaatacaaaattaataaagttaatggtagcaaagctgaccttgaactaatagatggaatgctaagggatatggaatttaaaaatttcatgccaaagataaaatcttctgataatggagttataccttatcaattgaaacttatggagctaaataagatccttgaaaaccaatccaaacaccatgaatttttaaacgtatccgatgaatatggaagcgtttgcgacaagattgcttcgattatggaatttaggattccatattatgttgggcctttaaatcctaactcaaaatatgcttggattaagaagcaaaaggacagcgaaatcacgccatggaattttaaagatgtagttgatttggattcttcaagggaagagtttatagatagcttaattggcaggtgcacatatttaaaagatgaaaaagttctaccaaaggcctcgcttctctacaatgagtatatggttttaaatgaactcaacaatttaaaattaaatgatcttcctattactgaagaaatgaagaagaaaatcttcgatcaactctttaagaccaggaaaaaagtaacattaaaggctgtcgctaatcttctcaaaaaagaatttaatataaatggagaaatcctattgtccggcacagatggggattttaaacaagggctaaactcttataacgattttaaggccattgttggggacaaggttgacagcgacgactatagggataaaatcgaagaaattatcaagctaatcgtcctctatggagatgacaaatcttacttgcaaaagaaaataaaggcgggatacggcaagtattttacagattcagaaatcaaaaagatggctggcctaaattataaagactggggcagattaagtaaaaaactactcacaggtttagaaggcgccaataaaattacaggcgaaagaggatctataatccattttatgcgtgagtacaatttaaacttaatggaattaatgagcgccagcttcacttttacagaggaaattcaaaagttaaatccagttgacgatagaaaactctcctatgagatggttgatgagctttatttatcaccttcagttaagagaatgttatggcaaagtctaagaatagttgatgaaattaaaaatataatgggcactgattccaagaaaatctttattgaaatggccaggggcaaagaagaagtcaaggctagaaaagaatctagaaaaaatcagctcttaaaattttacaaggatggcaaaaaagcctttatatcagaaatcggcgaagaaagatatagctatcttttaagtgaaatcgaaggagaagaggaaaacaaattcagatgggacaatctttatctctactacacccagcttggcaggtgtatgtatagtcttgagccaattgatatttcagaactctcatcgaaaaacatctatgaccaagaccacatttatccaaagtcaaaaatctatgatgattcaattgaaaacagagttttggttaagaaagatttaaatagcaagaaaggcaattcatacccaataccggatgagattttaaataaaaattgctatgcttattggaaaattctatatgacaagggactaattggtcaaaagaaatataccagacttacacgtaggacaggatttactgatgatgaacttgtccaatttatatccaggcaaatagttgagaccaggcaggctaccaaagaaacagcaaatctcttaaaaaccatttgcaaaaattcagaaatagtttactctaaggcagaaaatgctagcagattcagacaggaatttgatatagtaaaatgccgtgcagtcaatgacctccaccacatgcatgacgcttatataaatataatcgttggcaatgtctacaatacaaaatttaccaaagaccccatgaactttgtcaaaaaacaagagaaagctagaagttataacttggaaaacatgtttaaatatgacgtaaagcgcgggggctatacagcatggatagcagacgatgaaaaaggcactgttaaaaatgctagcatcaagagaataagaaaagaactagaggggaccaactacagatttactcgcatgaattatatagaaagtggtgcactatttaatgctaccctgcaaagaaaaaacaaaggaagtcgccctctaaaagataaggggcctaagagctcaatagaaaaatatggtggatatactaatataaacaaggcttgctttgcagtgttggatattaaatcaaaaaataaaatagaaagaaaattaatgccagttgaaagagaaatatacgctaagcaaaagaatgataaaaaattgagtgatgaaatatttagcaaatatttgaaagatagattcggaattgaagattatagagtagtatatcctgtagtaaagatgagaactttgttaaaaatagatggatcttattattttataactggtggaagtgacaaaacattggaattaaggagtgcacttcaattaatattaccaaagaaaaatgaatgggcaataaagcaaattgataaatccagtgagaatgattacctaacaattgaaaggatacaagatttaacggaagaacttgtatacaatacgtttgatataatagtgaataaatttaaaacatctgtatttaaaaaatcatttttgaatttattccaagatgataaaatcgaaaatatagattttaaattcaaatcaatggattttaaagaaaagtgtaaaactctattgatgctagtaaaagccatcagagcttctggtgtacgccaagacttaaaatctatagatttaaaatcagactatggtagattgagctccaagactaataatataggaaactatcaagaatttaaaatcataaaccaatcaattacaggcctctttgaaaacgaagtggacttgttaaaattatga

SEQ ID NO: 31132 - DNA, 4107 bp, Artificial Sequence
  Human optimized OMNI50 seq
accaaggtgaaggactactacataggcttggacatcggcacctctagcgtcgggtgggccgtcaccgatgaagcctataacgtgcttaagtttaatagcaagaaaatgtggggcgtgcggctgttcgacgacgctaagacggcagaggagcgtaggggccagcgaggagcaagacgacgtctggatcggaagaaggagagactcagcctgctgcaggacttcttcgccgaagaggtagcaaaggtcgaccccaacttcttcctcaggctggacaattccgatctgtacatggaagataaggaccagaaactgaaaagcaaatatacactgttcaacgacaaggacttcaaggataagaattttcataagaagtaccccacaatacatcacctgctgatggatctgatcgaggacgacagtaagaaggacatccggctcgtctacctggcctgtcactatttgctcaagaacaggggtcatttcatcttcgagggccagaagttcgacactaaatcaagcttcgagaacagtttgaacgagctcaaagttcatttgaacgacgagtatggactggacctcgaatttgacaacgagaacctgattaacatcttgactgacccaaaactcaataaaacggccaagaagaaggagctgaagtccgtaatcggcgacaccaagttcctcaaagccgtttccgcgataatgatcggctctagccagaaactcgtcgacttgttcgagaaccccgaggatttcgacgactctgcgataaagtccgttgacttctcaactacctctttcgacgacaagtactctgactatgaactcgctctgggtgacaagatcgctctggtcaacatccttaaggaaatttacgatagctccatcctcgagaacctgctcaaagaggcagacaagtctaaggacggtaacaaatatatcagtaatgcattcgtgaagaagtacaataaacacggacaagatctgaaagagttcaaacgtctggtacgacaatatcacaagagtgcgtattttgatattttcagatccgagaaggtgaatgacaattacgtcagctacactaaaagctcaattagcaacaataaacgcgtcaaagcaaacaagttcactgatcaagaggccttctacaaattcgccaagaaacatctggagacaatcaagtataagatcaacaaggtaaacggctccaaggcagatctggagctgattgacgggatgctgcgggacatggagttcaagaactttatgcccaaaattaagtccagtgacaacggggtgattccataccagctcaagctgatggaattgaacaaaatactcgagaatcagtcaaagcatcacgagttcctcaatgtcagcgacgagtacggctccgtgtgtgataaaatcgcatctatcatggagttccgtatcccctactacgtgggacccctgaaccccaatagcaagtacgcctggatcaagaagcagaaagatagtgagattactccctggaacttcaaggacgtcgtggaccttgactccagcagagaggagttcattgactcactgatcggacgctgtacttaccttaaggacgagaaggtccttcccaaagcttctttgctgtataacgaatacatggtgctgaacgagctgaataacctgaagttgaacgaccttcccatcaccgaggagatgaagaagaagatatttgaccagttgttcaaaacaagaaagaaggtcacccttaaagcggtggcaaacctgctgaagaaggagttcaacatcaacggcgagattctgctctctgggaccgacggtgacttcaagcagggcttgaactcatacaatgacttcaaagctatcgtgggcgataaagtcgattccgatgattaccgggacaagattgaggagatcattaaactgatagttctttacggtgacgataagagttaccttcagaagaagattaaagctgggtatggaaaatacttcaccgacagtgagattaagaaaatggcggggctgaactacaaggattggggaaggctctcaaagaagctgctgacgggactcgagggtgcaaacaagatcactggagagcggggctccattattcacttcatgagggaatataaccttaatctgatggagcttatgtcagcttcatttacgttcaccgaagagatacagaaacttaaccccgtggatgaccgcaagctgtcatacgaaatggtggacgaactgtacctttctcccagtgtgaaacggatgctctggcagtccctgcgcatcgtcgacgagataaagaacatcatgggaaccgacagtaagaagattttcatcgagatggctcggggtaaggaagaggtgaaagcccgcaaggagtcaaggaagaaccaactgctgaagttctataaagacggaaagaaggcattcatcagcgagattggcgaggagaggtactcttacttgctttctgagatagagggtgaggaagagaataagtttcgatgggataacctgtacctttattatactcaactgggtcgctgcatgtactctttggaacctatcgacatatctgagctgtcttcaaagaatatttacgatcaggatcatatctaccccaaaagcaagatttacgacgacagtatcgagaatagggtgctggtgaagaaggaccttaactccaagaagggtaacagctatcctatcccagacgaaatcctgaacaagaactgttacgcctactggaagatcctgtacgataaaggtcttatcgggcagaagaagtacactcggctgacccggagaactggcttcacggacgacgagctcgttcagttcatctcaagacagatcgtggaaactagacaagcaacaaaggagactgctaacctgctcaagacaatatgtaagaactccgagatcgtgtattccaaagccgagaacgcaagtcggtttaggcaagagttcgacatcgtgaagtgtagggcggtgaacgatcttcatcatatgcacgatgcctacatcaacatcatagtggggaacgtgtataacaccaagttcacgaaggaccctatgaatttcgtaaagaagcaggaaaaggcgcggagctacaatctcgagaatatgttcaagtacgatgtgaaacgtggcggatacaccgcttggatcgccgatgacgagaagggcaccgtgaagaacgcgagtattaaacgtatccggaaggagctggaaggcacaaattataggttcacaagaatgaactacattgagtctggagcgcttttcaacgccactctccagcggaagaataagggctccagacccctgaaggacaaaggcccgaaatcttccatcgagaagtacggcggctacacaaacatcaataaagcctgtttcgctgttcttgacatcaagtctaagaacaagattgagaggaagctgatgcccgtcgagcgtgagatctatgccaaacagaagaacgacaagaagctgtccgacgagattttctcaaagtacctcaaggaccgatttggcatcgaggactacagggttgtctacccagtggtgaaaatgcgcacactgctcaagatcgacggcagctactacttcatcacaggcggttctgataagaccctggagttgcgatctgctctgcagctgattctccctaagaagaacgagtgggcgatcaaacagatcgacaagtcttccgaaaacgactatctgacgatcgagcgtatccaggacctgaccgaggagctggtgtataacactttcgacatcatcgtcaacaagttcaagaccagtgtcttcaagaagtctttccttaacttgtttcaggacgacaagattgagaacattgacttcaagtttaagtccatggacttcaaggagaaatgcaagacacttctcatgctggtcaaggcgattcgggcatccggcgtgaggcaggatctcaagtccatcgacctcaagtctgattacggacggctcagttcaaagaccaacaacatcggcaattaccaggagttcaagattattaatcagtccatcactggactgttcgagaatgaggtcgatctcctgaagctg

SEQ ID NO: 31133 - DNA, 4110 bp, Clostridium sp. AF02-29
atgaaagagaaaatggaatactatttaggtcttgacatgggaaccaattcagtcggatgggctgtaacagataaagaatatcgtttgatgcgggcgaagggaaaagatttgtggggagttcgtttgttcgaacgtgctaatacagctgaagaacggcgggcatataggattaaccgaagaagacgtcagcgggaagtagctagaattggaattttaaaagaattatttgccgatgaaattgcaaaagttgatgctaatttttttgcacgcctggacgacagtaaatattatcttgatgatagacaggaaaataataaacagaagtatgcgatatttgctgataaagattacacggacaaagagtattttagccaatatcagacaatttttcatctgagaaaagaactgatcctgtcagatcaacctcatgatgttcgtcttatttatctggcgctgttaaatatgtttaaacatagaggccattttttaaataaaacgttgggaacctcggaatcattagaatcgttttttgatatgtatcaaagattagctgtatgtgcggatggagagggaatcaaacttccagaaacggtggatttaaagaaattagaacagatacttggagcacgtggatgctctagaaaggcaacattggaacatatatctgaaataatggggattaataaaaagaataaaccagtttatagcctcatgcagatgatatgtggacttgatactaaaatgatagacctttttgggcagaagattgatgaagaacacaaaaaaatctctctttcatttcgaacgtccaattatgaagaaatggcagaggaagtccgtaatacgataggggatgatgcatttgaacttatattgacagcaaaagaaatgcatgattttggcttgctggcggagattatgaaaggatattcatatttgtcagaagcgcgggtggctgtctatgaagagcatcgaaaggatttggctaaactgaaagccgtctttaaacaatatgaccataaggcatatgatgaaatgtttcgaatcatgaagaatggtacttatagtgcctatgttggaagtgtaaatagtttcggtaaaatagagagaaggacagtaaaaacttccagagaagaattgttaaaaaatataaagaaaattttaacagggtttccagaggatgatgctacagtacaggaatttttgggtaagatagattcggatacacttctccaaaaacaactgacagcttctaatggagtgattccaaatcaggtacatgcaaaagaaatgaaggtcattttgaaaaatgcagaaaaataccttccatttttaagtgaaagagatgaaacaggattaagtgtatcagaaaaaataatagctctgtttacatttacgatcccgtactatgttggtcctcttgggcagcaacatttaggaaaggaatgtgcacatggctgggtagagcgaaaagaaaaaggtactgtgtatccatggaattttgaacaaaaggttgatttaaaggcaagtgcagaacattttatagaaagaatggtaaaacattgcacgtatttatctgatgagcaggcattgccaaaacaatcattgttgtatgaaaaatttcaggtattgaatgaattaaacaatttaaaaattcgaggagaaaaaatatcggtagaattaaaacagcagatatatcgggatgtctttgaacatactgggaaaaaagtatcgatgaagcagttggaaaactatctgaagttgaacggcctgcttgaaaaagacgaaaaggacgcagttacaggaatagatggtggtttccatagttatttgtcctctttaggaaaatttataggaattttgggagaagaagctcattatggtaaaaaccagaatatgatggaaaaaattgtattttgggggacagtatatggacaggataaaaaattccttcgcgaacggttaagtgaagtttatggagatagattgtcaaaagagcagattcgtcgtattactggtatgaaatttgaaggatggggacgactttctaaagaatttcttttactggagggggcttctagagaagaaggggagattcggacattgattcgttcattatgggagacaaatgaaaatttgatggggcttttaagtgaacgatatacatatagcgaagaagtacgagaaaaaacgctagagtgtgagaagagcctttctgaatggacgattgaagatttggaaggaatgtatctgtcagcaccggttaagcgcatggtatggcagactttgttaattgtaaaagagcttgaaaaggtgctgggatgtgctccacgacgtatttttgtggagatggcacgcgaagatgcggagaaaggaaggagaacagaatcacgaaagcagaaattgcagaatctttataaagcaattaaaaaagaggagatagactggaaaaaagagattgatgaaaaaacagagcaggcattccgcagtaaaaaattatatttgtattacctgcagaaggggcgctgtatgtatacgggcgagtctattcgatttgaagatttgatgaatgataatttatatgatatcgatcatatttatccgagacattttgtgaaggatgatagtttagagcagaatctggtgctggtaaagaaggaaaaaaatgcacataaaagtgatgtatttccgattgaggcggatattcagaaaaagatgagtccgttctggaaagaactgaaagaaagaggttttatatcagaagaaaagtatatgcgtttaacgaggaggtatggcttttcggaagaggaaaaagcaggttttatcaatcggcaattggtggaaacaagacagggaacaaagagtattacagagatattgggacaagcttttccagatgtggatatcatattttcaaaagcgtcgaatgtgtcggagttcagacatatttatggattgtataaggttcgcagtataaatgattttcatcatgcacatgacgcatacttaaatatagtggttggaaatacgtatcatgtgaaatttacgaaaaatccgttgaattttattcgggaagcagaaaaaaatccgcagaatgcagaaaataaatacaatatgaaccggatgttcgattggacagtaaaaagaggaaatgaaacggcatggatagcaagttccgataaagaagcaggtagtattaaaattgtaaaggctatattggcaaaaaatacaccattagttactaagaggtgtgcggaggcacatggaggaataaccaggaaagcaactatctggaataaaaacaaagctgctggcagcggatatattccggttaagatgaatgatgcaagacttttggatgttacaaaatatggcggtttgacatctgtatcagcttcggggtacactttgctggaatatgatgtaaaaggtaaaaaaataagaagtcttgaggcgattccaatttacttgggacgagtgtctgaattgacaaatgaggcgattttgaaatattttgaaaaagtgctgatagaggaaaataagggaaaagaaataacagaacttcgcatttgtaagaagtttattccgagagagtcgttagtgagatataatgggtattactattatctcggaggaaaatcagtggaacagattgtattgaaaaatgcgacacagatggcatattcagaagaagaaacatgttatataaaaaagatagaaaaagctatagaaaaaacatattatgaagaagtggacaaaaataaaaatgtgattttgacaaaaactagaaacaatgcaatgtatgataaatttattataaaatatcagaattcaatttatcagaatcaaagtggtgcaatgaaaaattctattattggaaaaagaaatgaatttttaacattatcattggaaaagcagtgtagaatattgaaggcactagtagaatattttaggacaggagatattattgatttgagagaattaggaggtagttcacaggcaggaaaagtggctatgaacaagaaaattatgggagcaagtgaattagtgctaataagtcaatctccaacaggtttattccaacaagagattgatttactaaaaatatga

SEQ ID NO: 31134 - DNA, 4104 bp, Artificial Sequence
  Human optimized OMNI53 seq
aaggaaaagatggagtattacctggggctggatatgggcactaacagcgtgggttgggcggtgaccgacaaggagtaccggctgatgagggcaaaagggaaggacctgtggggcgtacggctgtttgagagagcgaacactgcggaagagaggcgcgcctacagaatcaatagacgacggcggcaacgagaggttgcaaggatcggtatccttaaggaactcttcgctgacgagatcgccaaggtggacgcaaacttcttcgccagacttgatgattcaaagtactacctggacgaccggcaagagaacaacaagcagaaatacgctattttcgccgacaaggactatactgataaggaatacttctcccagtaccaaactatcttccatctccggaaggagcttatactcagtgaccagccacacgacgtgagactgatctaccttgctcttctgaacatgttcaagcaccggggacacttcttgaacaagactctggggacttccgagagtttggagtctttcttcgacatgtaccagcgactggcagtgtgcgcagacggggaaggcattaagttgcccgagaccgtagaccttaagaagctcgagcaaatcctgggcgcccggggatgtagcaggaaagccacccttgagcacatcagcgagattatgggaatcaacaagaagaacaagcccgtctactccctgatgcaaatgatttgcggtctggacaccaagatgatcgatctgttcggacaaaagatcgacgaggagcataagaagataagcctgtccttcagaactagcaactacgaggagatggccgaagaggttagaaacacaattggcgacgacgccttcgagctgattctcactgccaaggagatgcacgacttcgggctgttggctgaaatcatgaaggggtactcctacctgagcgaggctcgcgttgccgtgtacgaggaacaccggaaagacctggccaagctcaaggcagtgttcaagcagtacgatcacaaagcttacgacgagatgttcaggattatgaagaacgggacatactcagcttacgtagggtccgtgaactcctttggcaagatcgaacgcagaaccgtgaagacctctcgcgaggagcttcttaagaacattaagaagatcctgaccggtttccccgaagacgacgcaactgtgcaagagttcctcgggaaaattgactctgacacgctgcttcagaagcagttgactgccagcaacggcgtaatccctaaccaagtccacgcgaaggagatgaaagtaatcctgaagaacgccgagaagtatctgcctttcctgtccgagagggacgagactgggctctcagtctccgagaagatcattgcattgttcacgttcactattccttattacgtgggacccctgggtcaacagcacttggggaaagagtgcgcccacggttgggtggaaagaaaggagaaggggaccgtttacccctggaacttcgagcagaaagtcgaccttaaagcttccgctgagcacttcattgagcgcatggtgaagcactgtacatacctgtccgacgaacaagctctgcccaagcagagtctgctctacgagaagttccaagtgcttaacgagctcaataacttgaagatcaggggcgagaagatcagtgtggagctgaagcaacaaatttaccgggacgttttcgagcacaccggaaagaaggtttcaatgaaacaactggagaattacttgaaactgaatgggcttctggagaaggatgagaaagatgccgtgaccgggatcgacggcggatttcactcatacctttcttccctgggcaagttcatcggcatcctcggggaagaggcacactacggaaagaatcaaaacatgatggagaagatcgtgttctggggtacggtgtacgggcaagacaagaagtttctgcgggagcgtctgtccgaggtgtacggcgaccggctgagcaaggaacaaatcagaaggataacaggaatgaagttcgagggctggggccggctctccaaggagttcctgctgctcgaaggagcaagtcgggaagagggcgaaatccgcaccctcatacggagcctgtgggaaacgaacgagaacctgatgggactgctgtcagagagatacacttactcagaagaggtccgcgagaagactctcgaatgcgagaaatctctgtcagagtggaccatcgaggacctcgagggcatgtacctttccgcccctgtaaaacggatggtctggcaaaccctcttgatagtgaaggaactggagaaagtcctcggctgcgcccctcgaaggatcttcgttgaaatggctagagaggacgcagaaaagggtcgccggaccgagtcccgcaaacaaaagctgcaaaacctgtacaaggctatcaagaaggaagaaattgattggaagaaggaaatcgacgagaagaccgaacaagcctttaggagcaagaagctgtacctgtactatctccagaaaggacgatgcatgtacaccggagaaagcatccgcttcgaggacctcatgaacgacaacttgtacgacatagaccacatctacccccggcacttcgttaaagacgactcccttgaacaaaacctcgttttggttaagaaggagaagaacgctcacaagagcgacgtgttcccaatcgaagccgacatacaaaagaaaatgtctcccttttggaaggagctcaaggagaggggattcatctctgaggagaaatacatgagactcactcgaagatacgggttcagtgaggaagagaaggctggattcattaacagacagctggtagagacccgtcaaggcacgaaatctatcactgaaatcctgggccaggccttccccgacgttgacataattttctccaaggcttcaaacgtttcagaatttcggcacatctacggcctctacaaagtgaggtctattaacgacttccaccacgcgcacgatgcttatctgaacatcgtcgtaggcaacacttaccacgttaagttcacaaagaaccccctgaacttcatccgcgaggccgagaagaacccacaaaacgccgagaacaagtataacatgaatcgcatgtttgactggaccgtgaagaggggcaacgagactgcctggatcgccagcagtgacaaagaggccggatctatcaagatagtcaaagcgattcttgccaagaacacccctcttgtgaccaaacggtgcgcagaagctcacggcggcattactcgcaaggcgacaatttggaacaagaataaggccgcgggttctggctacatcccagtgaaaatgaacgacgcccggctcctggacgtgaccaagtacggcggactgacctcagtgagtgcgtccggctataccctgcttgagtacgacgtgaaggggaagaagattcgatccctggaagctatccccatctatcttgggagagtcagtgagctcactaacgaagccatcctcaagtacttcgagaaggttcttatcgaagagaacaaagggaaggagattaccgagctccgtatctgcaagaagttcataccccgtgaaagcctcgttcggtacaacggatactattactacctgggcggcaagtctgttgagcaaatagtcctgaagaacgccacccaaatggcttactccgaggaagagacttgctacatcaagaaaattgagaaggcaattgagaagacctactacgaagaggtcgataagaacaagaacgtaatactgactaagacccgcaataacgcgatgtacgacaagttcatcattaagtaccaaaacagtatataccaaaaccagagcggagccatgaagaactcaatcatagggaagaggaacgagttcctgactctcagtctcgagaaacaatgccgcatcctcaaagctctggtcgagtacttccggaccggggacatcatagacctgcgggagctcggcggatcaagccaagcgggcaaggtcgcgatgaataagaagatcatgggcgcgagcgagctggtcctgatttcacagtcccccaccgggttgtttcagcaggaaatcgacctgctgaagatt

SEQ ID NO: 31135 - DNA, 6670 bp, Artificial Sequence
  pbNNC2 OMNI39
gttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcgggatctcgacgctaaattaatacgactcactataggggaattgtgagcggataacaattcccctgtagaaataattttgtttaactaaagaggagaaatttcatatgtacccatacgatgtgccagattacgctggcaccgagctcggtaccggctatacaattggcctggatctgggcgttgcctctcttggctgggccgtcgtgaatgatgagtacgaggtgctggaaagctgcagcaacatctttcctgccgccgagagcgccaacaacgtggaaagaagaggcttccggcaaggcagacggctgagcagaagaagaaggacccggatcagcgacttcagaaagctgtgggagaagtccggcttcgaggtgcccagcaatgagctgaatgaggtgctgcagtaccggatcaagggcatgaacgacaagctgagcgaggacgagctgtaccacgtgctgctgaacagcctgaagcacagaggcatcagctacctggacgacgccgatgatgagaacgcctctggcgattatgccgcctctatcgcctacaacgagaaccagctgaaaacaaagctgccctgcgagatccagtgggagagatacaagaagtacggcgcctaccggggcaacatcacaatccaagaaggcggcgagcccctgacactgagaaatgtgtttaccaccagcgcctacgagaaagagatccagaaactgctggacgtgcagagcatgagcaacgagaaagtgaccaagaagttcatcgacgagtacctcaagatcttcagccggaagagagagtactacatcggccctggcaacaagaagtccagaaccgactacggcgtgtacaccacacagaagaacgaggacggcacctaccacaccgagcagaacctgttcgataagctgatcggcaagtgcagcgtgtaccctgatgagcgtagagccgctggcgccacatacacagcccaagagttcaacctgctgaacgatctgaacaacctggtcatcgacggccggaagctggacgagcaagagaagtgtcagatcgtggatgccgtgaagcacgccaagaccgtgaacatgaagaacatcattgccaaagtgatcggcaccaaggccaacagcatgaacatgaccggcgccagaatcgacaagaatgagaaagaaatcttccacagcttcgaggcctacaacaagctgcggaaggccctggaagagatcgacttcgacatcgagacactgagcaccgacgagctggatgccattggagaggtgctgaccctgaacaccgaccggaagtctatccagaacggcctgcaagagaaacggatcgtggtgcccgatgaagtgcgggatgtgctgatcgccaccagaaagagaaatggcagcctgttctccaagtggcagagcttcggcatccggatcatgaaggaactgatcccagagctgtacgcccagcctaagaaccagatgcagctgctgaccgacatgggcgtgttcaagaccaaggacgagagattcgtggaatacgacaagatccccagcgacctgatcaccgaagagatctacaaccccgtggtggccaagacagtgcggatcaccgttagagtgctgaacgccctgatcaagaagtatggctaccccgaccgggtcgtgatcgagatgcccagagataagaactccgaggaagagaagaagcggatcgccgacttccagaagaacaacgaaaacgagcttggcggcatcatcaagaaagtgaagtccgagtacggcatcgagatcaccgacgccgactttaagaaccacagcaagctgggcctgaagctgagactgtggaacgagcagaatgagacatgcccctacagcggcaagcacatcaagatcgacgacctgctcaacaaccccaacatgttcgaggtggaccacatcatccctctgagcatcagcttcgacgacagcagagccaacaaggtgctggtgtacgccgccgaaaaccagaacaagggcaacagaacccctatggcctacctgagcaacgtgaacagagagtgggacttccacgagtacatgagcttcgtgctgagcaactacaagggcaccatctacggcaagaagcgggacaatctgctgttctccgaggacatctacaagatcgatgtgctgcagggcttcatctcccggaacatcaacgacaccagatacgcctctaaagtgatcctgaactccctgcagagctttttcggcagcaaagaatgcgacaccaaagtgaaggtcgtgcggggcaccttcacacaccagatgcggatgaacctgaagatcgagaagaaccgggaagagtcctacgtgcaccacgccgtggatgctatgctgattgccttcagccagatgggctacgacgcctaccacaaactgaccgagaagtatatcgactacgagcacggcgagttcgtggaccagaagggatacgagaagctgattgagaacgacgtggcctacagagagacaacctatcagaacaagtggatgaccatcaagaagaatatcgagatcgccgctgagaaaaacaagtactggtatcaagtgaatcggaagtccaaccggggcctgtgcaaccagaccatctatggcaccagaaacctggacggcaaaaccgtgaagatctccaagctggacatccggaccgacgacggcatcaaaaagtttaagggcatcgtggaaaagggcaagctggaacggttcctgatgtaccggaacgaccccaagaccttcgagtggctgctgcagatctataaggactacagcgacagcaagaaccccttcgtgcagtacgagtctgagacaggcgacgtgatcaaaaaggtgtccaagacaaacaacggccccaaagtgtgcgagctgagatacgaggatggcgaagtgggctcctgcatcgacatcagccacaaatacggctacaagaagggcagcaagaaagtcatcctggattctctgaacccctaccggatggacgtgtactacaacaccaaggacaaccggtactacttcgtgggcgtgaagtactccgacatcaagtgccagggcgacagctacgtgatcgacgaggataagtatgccgccgctctggtgcaagaaaagatcgtgccagaaggcaagggcagatccgatctgaccgagctgggctatgagttcaagctgtccttctacaagaacgagatcatcgagtacgagaaggacggggagatctacgtcgagcggttcctgtccagaacaatgcctaaagtgtccaactatatcgagacaaagcccctggaagccgccaagttcgagaagagaaacctcgtgggcctcgccaagacaagccggatcagaaagatcagagtggacatcctggggaaccgctacctgaacagcatggaaaacttcgacttcgtcgtgggccacaagggatcctaagcggccgcctagcataaccccttggggcctctaaacgggtcttgaggggttttttgacctaggctaggggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctcgtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcctcgagtcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgacacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagtt

SEQ ID NO: 31136 - DNA, 2567 bp, Artificial Sequence
  pbGuide OMNI39 T2 sgRNA V2
gcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaacacatttccccgaaaagtgccacctgacgtcctcgagtcccgcataatcgaaatttgacagctagctcagtcctaggtataatactagtggaagagcagagccttggtctcgttttagtacctagagaaagaaatttctttagacctactaaaataaggctttatgccgagattaaaggatgccgacgggcatccttttttgaattctcaaataaaacgaaaggctcagtcgaaagactgggcctttcgttttatctgttgtttgtcggtgaacgctctcctgagtaggacaaatggtaccccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccg

SEQ ID NO: 31137 - DNA, 5009 bp, Artificial Sequence
  pbPOS T2 library
  misc_feature (3040)..(3047): n is a, c, g, or t
tcgagtctttacactttatgcttccggctcgtatgttgtgtggaattgtgagcggataacaatttcacacatgattacggattcaacgtcgtgactggtaaaacccgggcgttacccaacttaatcgccttgcagcacatccccctttcgccagcaggcgtaataaggaaaggattcatgtactatttgaaaaacacaaacttttggatgttcggtttattctttttcttttacttttttatcatgggagcctacttcccgtttttcccgatttggctacatgatatcaaccatatcagcaaaagtgatacgggtattatttttgccgctatttctctgttctcgctattattccaaccgctgtttggtctgctttctgacaaactcggtctacgcaaatacctgctgtggattattaccggcatgttagtgatgtttgcgccgttctttatttttatcttcgggccactgctgcagtacaacattttagtagggtcgattgttggtggtatttatctaggctttagttttaacgccggtgcgccagcagtagaggcatttattgagaaagtcagccggcgcagtaatttcgaatttggtcgcgcgcggatgtttggcagtgttggctgggcgctggttgcctcgattgtcgggatcatgttcaccattaataatcagtttgttttctggctgggctctggcagttgtctcatcctcgccgttttactctttttcgccaaaacggacgcgccctcaagtgccacggttgccaatgcggtaggtgccaaccattcggcatttagccttaagctggcactggaactgttcagacagccaaaactgtggtttttgtcactgtatgttattggcgtttcctccacctacgatgtttttgaccaacagtttgctaatttctttacttcgttctttgctaccggtgaacagggtacccgcgtatttggctacgtaacgacaatgggcgaattacttaacgcctcgattatgttctttgcgccactgatcattaatcgcatcggtgggaagaatgccctgctgctggctggcactattatgtctgtacgtattattggctcatcgttcgccacctcagcgctggaagtggttattctgaaaacgctgcatatgtttgaagtaccgttcctgctggtgggctcctttaaatatattactagtcagtttgaagtgcgtttttcagcgacgatttatctggtcagtttcagcttctttaagcaactggcgatgatttttatgtctgtactggcgggcaatatgtatgaaagcataggtttccaaggcgcttatctggtgctgggtctggtggcgctgggcttcaccttaatttccgtgttcacgcttagcggcccgggcccgctttccctgctgcgtcgtcaggtgaatgaagtcgcttaaaggcctcgatgcagctagcatgctaatctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggggtagcgattgaaaacgatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttttggggaatataatcttctagacatacaatggaagagcagagccttggtctcnnnnnnnnaagcttgatatcgaattcctgcagcccgggggatcccatggtacgcgtgctagaggcatcaaataaaacgaaaggctcagtcgaaagactgggcctttcgttttatctgttgtttgtcggtgaacgctctcctgagtaggacaaatccgccgccctagacctaggcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattatcatgacattaacctataaaaataggcgtatcacgaggccctttcgtcttcacc

SEQ ID NO: 31138 - DNA, 6439 bp, Artificial Sequence
  pET9a OMNI50-HisTag
taatacgactcactatagggagaccacaacggtttccctctagagagacaataaccctgataatgcttcaataatattgaaaaaggaagagtatgcctaagaagaagagaaaggtgggtaccaccaaggtgaaggactactacataggcttggacatcggcacctctagcgtcgggtgggccgtcaccgatgaagcctataacgtgcttaagtttaatagcaagaaaatgtggggcgtgcggctgttcgacgacgctaagacggcagaggagcgtaggggccagcgaggagcaagacgacgtctggatcggaagaaggagagactcagcctgctgcaggacttcttcgccgaagaggtagcaaaggtcgaccccaacttcttcctcaggctggacaattccgatctgtacatggaagataaggaccagaaactgaaaagcaaatatacactgttcaacgacaaggacttcaaggataagaattttcataagaagtaccccacaatacatcacctgctgatggatctgatcgaggacgacagtaagaaggacatccggctcgtctacctggcctgtcactatttgctcaagaacaggggtcatttcatcttcgagggccagaagttcgacactaaatcaagcttcgagaacagtttgaacgagctcaaagttcatttgaacgacgagtatggactggacctcgaatttgacaacgagaacctgattaacatcttgactgacccaaaactcaataaaacggccaagaagaaggagctgaagtccgtaatcggcgacaccaagttcctcaaagccgtttccgcgataatgatcggctctagccagaaactcgtcgacttgttcgagaaccccgaggatttcgacgactctgcgataaagtccgttgacttctcaactacctctttcgacgacaagtactctgactatgaactcgctctgggtgacaagatcgctctggtcaacatccttaaggaaatttacgatagctccatcctcgagaacctgctcaaagaggcagacaagtctaaggacggtaacaaatatatcagtaatgcattcgtgaagaagtacaataaacacggacaagatctgaaagagttcaaacgtctggtacgacaatatcacaagagtgcgtattttgatattttcagatccgagaaggtgaatgacaattacgtcagctacactaaaagctcaattagcaacaataaacgcgtcaaagcaaacaagttcactgatcaagaggccttctacaaattcgccaagaaacatctggagacaatcaagtataagatcaacaaggtaaacggctccaaggcagatctggagctgattgacgggatgctgcgggacatggagttcaagaactttatgcccaaaattaagtccagtgacaacggggtgattccataccagctcaagctgatggaattgaacaaaatactcgagaatcagtcaaagcatcacgagttcctcaatgtcagcgacgagtacggctccgtgtgtgataaaatcgcatctatcatggagttccgtatcccctactacgtgggacccctgaaccccaatagcaagtacgcctggatcaagaagcagaaagatagtgagattactccctggaacttcaaggacgtcgtggacctcgactccagcagagaggagttcattgactcactgatcggacgctgtacttaccttaaggacgagaaggtccttcccaaagcttctttgctgtataacgaatacatggtgctgaacgagctgaataacctgaagttgaacgaccttcccatcaccgaggagatgaagaagaagatatttgaccagttgttcaaaacaagaaagaaggtcacccttaaagcggtggcaaacctgctgaagaaggagttcaacatcaacggcgagattctgctctctgggaccgacggtgacttcaagcagggcttgaactcatacaatgacttcaaagctatcgtgggcgataaagtcgattccgatgattaccgggacaagattgaggagatcattaaactgatagttctttacggtgacgataagagttaccttcagaagaagattaaagctgggtatggaaaatacttcaccgacagtgagattaagaaaatggcggggctgaactacaaggattggggaaggctctcaaagaagctgctgacgggactcgagggtgcaaacaagatcactggagagcggggctccattattcacttcatgagggaatataaccttaatctgatggagcttatgtcagcttcatttacgttcaccgaagagatacagaaacttaaccccgtggatgaccgcaagctgtcatacgaaatggtggacgaactgtacctttctcccagtgtgaaacggatgctctggcagtccctgcgcatcgtcgacgagataaagaacatcatgggaaccgacagtaagaagattttcatcgagatggctcggggtaaggaagaggtgaaagcccgcaaggagtcaaggaagaaccaactgctgaagttctataaagacggaaagaaggcattcatcagcgagattggcgaggagaggtactcttacttgctttctgagatagagggtgaggaagagaataagtttcgatgggataacctgtacctttattatactcaactgggtcgctgcatgtactctttggaacctatcgacatatctgagctgtcttcaaagaatatttacgatcaggatcatatctaccccaaaagcaagatttacgacgacagtatcgagaatagggtgctggtgaagaaggaccttaactccaagaagggtaacagctatcctatcccagacgaaatcctgaacaagaactgttacgcctactggaagatcctgtacgataaaggtcttatcgggcagaagaagtacactcggctgacccggagaactggcttcacggacgacgagctcgttcagttcatctcaagacagatcgtggaaactagacaagcaacaaaggagactgctaacctgctcaagacaatatgtaagaactccgagatcgtgtattccaaagccgagaacgcaagtcggtttaggcaagagttcgacatcgtgaagtgtagggcggtgaacgatcttcatcatatgcacgatgcctacatcaacatcatagtggggaacgtgtataacaccaagttcacgaaggaccctatgaatttcgtaaagaagcaggaaaaggcgcggagctacaatctcgagaatatgttcaagtacgatgtgaaacgtggcggatacaccgcttggatcgccgatgacgagaagggcaccgtgaagaacgcgagtattaaacgtatccggaaggagctggaaggcacaaattataggttcacaagaatgaactacattgagtctggagcgcttttcaacgccactctccagcggaagaataagggctccagacccctgaaggacaaaggcccgaaatcttccatcgagaagtacggcggctacacaaacatcaataaagcctgtttcgctgttcttgacatcaagtctaagaacaagattgagaggaagctgatgcccgtcgagcgtgagatctatgccaaacagaagaacgacaagaagctgtccgacgagattttctcaaagtacctcaaggaccgatttggcatcgaggactacagggttgtctacccagtggtgaaaatgcgcacactgctcaagatcgacggcagctactacttcatcacaggcggttctgataagaccctggagttgcgatctgctctgcagctgattctccctaagaagaacgagtgggcgatcaaacagatcgacaagtcttccgaaaacgactatctgacgatcgagcgtatccaggacctgaccgaggagctggtgtataacactttcgacatcatcgtcaacaagttcaagaccagtgtcttcaagaagtctttccttaacttgtttcaggacgacaagattgagaacattgacttcaagtttaagtccatggacttcaaggagaaatgcaagacacttctcatgctggtcaaggcgattcgggcatccggcgtgaggcaggatctcaagtccatcgacctcaagtctgattacggacggctcagttcaaagaccaacaacatcggcaattaccaggagttcaagattattaatcagtccatcactggactgttcgagaatgaggtcgatctcctgaagctgggatcctacccatacgatgttccagattacgcggccgctccaaaaaagaaaagaaaagttgcggctagccatcatcaccatcaccatcatcattaaggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttcgatcccgcgaaat

SEQ ID NO: 31139 - DNA, 9542 bp, Artificial Sequence
  pmOMNI OMNI39
ggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgcctaagaagaagagaaaggtgggtaccggctatacaattggcctggatctgggcgttgcctctcttggctgggccgtcgtgaatgatgagtacgaggtgctggaaagctgcagcaacatctttcctgccgccgagagcgccaacaacgtggaaagaagaggcttccggcaaggcagacggctgagcagaagaagaaggacccggatcagcgacttcagaaagctgtgggagaagtccggcttcgaggtgcccagcaatgagctgaatgaggtgctgcagtaccggatcaagggcatgaacgacaagctgagcgaggacgagctgtaccacgtgctgctgaacagcctgaagcacagaggcatcagctacctggacgacgccgatgatgagaacgcctctggcgattatgccgcctctatcgcctacaacgagaaccagctgaaaacaaagctgccctgcgagatccagtgggagagatacaagaagtacggcgcctaccggggcaacatcacaatccaagaaggcggcgagcccctgacactgagaaatgtgtttaccaccagcgcctacgagaaagagatccagaaactgctggacgtgcagagcatgagcaacgagaaagtgaccaagaagttcatcgacgagtacctcaagatcttcagccggaagagagagtactacatcggccctggcaacaagaagtccagaaccgactacggcgtgtacaccacacagaagaacgaggacggcacctaccacaccgagcagaacctgttcgataagctgatcggcaagtgcagcgtgtaccctgatgagcgtagagccgctggcgccacatacacagcccaagagttcaacctgctgaacgatctgaacaacctggtcatcgacggccggaagctggacgagcaagagaagtgtcagatcgtggatgccgtgaagcacgccaagaccgtgaacatgaagaacatcattgccaaagtgatcggcaccaaggccaacagcatgaacatgaccggcgccagaatcgacaagaatgagaaagaaatcttccacagcttcgaggcctacaacaagctgcggaaggccctggaagagatcgacttcgacatcgagacactgagcaccgacgagctggatgccattggagaggtgctgaccctgaacaccgaccggaagtctatccagaacggcctgcaagagaaacggatcgtggtgcccgatgaagtgcgggatgtgctgatcgccaccagaaagagaaatggcagcctgttctccaagtggcagagcttcggcatccggatcatgaaggaactgatcccagagctgtacgcccagcctaagaaccagatgcagctgctgaccgacatgggcgtgttcaagaccaaggacgagagattcgtggaatacgacaagatccccagcgacctgatcaccgaagagatctacaaccccgtggtggccaagacagtgcggatcaccgttagagtgctgaacgccctgatcaagaagtatggctaccccgaccgggtcgtgatcgagatgcccagagataagaactccgaggaagagaagaagcggatcgccgacttccagaagaacaacgaaaacgagcttggcggcatcatcaagaaagtgaagtccgagtacggcatcgagatcaccgacgccgactttaagaaccacagcaagctgggcctgaagctgagactgtggaacgagcagaatgagacatgcccctacagcggcaagcacatcaagatcgacgacctgctcaacaaccccaacatgttcgaggtggaccacatcatccctctgagcatcagcttcgacgacagcagagccaacaaggtgctggtgtacgccgccgaaaaccagaacaagggcaacagaacccctatggcctacctgagcaacgtgaacagagagtgggacttccacgagtacatgagcttcgtgctgagcaactacaagggcaccatctacggcaagaagcgggacaatctgctgttctccgaggacatctacaagatcgatgtgctgcagggcttcatctcccggaacatcaacgacaccagatacgcctctaaagtgatcctgaactccctgcagagctttttcggcagcaaagaatgcgacaccaaagtgaaggtcgtgcggggcaccttcacacaccagatgcggatgaacctgaagatcgagaagaaccgggaagagtcctacgtgcaccacgccgtggatgctatgctgattgccttcagccagatgggctacgacgcctaccacaaactgaccgagaagtatatcgactacgagcacggcgagttcgtggaccagaagggatacgagaagctgattgagaacgacgtggcctacagagagacaacctatcagaacaagtggatgaccatcaagaagaatatcgagatcgccgctgagaaaaacaagtactggtatcaagtgaatcggaagtccaaccggggcctgtgcaaccagaccatctatggcaccagaaacctggacggcaaaaccgtgaagatctccaagctggacatccggaccgacgacggcatcaaaaagtttaagggcatcgtggaaaagggcaagctggaacggttcctgatgtaccggaacgaccccaagaccttcgagtggctgctgcagatctataaggactacagcgacagcaagaaccccttcgtgcagtacgagtctgagacaggcgacgtgatcaaaaaggtgtccaagacaaacaacggccccaaagtgtgcgagctgagatacgaggatggcgaagtgggctcctgcatcgacatcagccacaaatacggctacaagaagggcagcaagaaagtcatcctggattctctgaacccctaccggatggacgtgtactacaacaccaaggacaaccggtactacttcgtgggcgtgaagtactccgacatcaagtgccagggcgacagctacgtgatcgacgaggataagtatgccgccgctctggtgcaagaaaagatcgtgccagaaggcaagggcagatccgatctgaccgagctgggctatgagttcaagctgtccttctacaagaacgagatcatcgagtacgagaaggacggggagatctacgtcgagcggttcctgtccagaacaatgcctaaagtgtccaactatatcgagacaaagcccctggaagccgccaagttcgagaagagaaacctcgtgggcctcgccaagacaagccggatcagaaagatcagagtggacatcctggggaaccgctacctgaacagcatggaaaacttcgacttcgtcgtgggccacaagggatcctacccatacgatgttccagattacgcggccgctccaaaaaagaaaagaaaagttgaattcggcggcagcggcgccaccaacttcagcctgctgaagcaggccggcgacgtggaggagaaccccggccccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtagctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttgga

SEQ ID NO: 31140 - DNA, 2726 bp, Artificial Sequence
  pmGuide OMNI39 CXCR4 sgRNA V3
gagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccaagtgataaacacgaggagtttaagtacctagagaaagaaatttctttagacctacttaaataaggctttatgccgagattaaaggatgccgacgggcatccttttttgaattctcaaataaaacgaaaggctcagtcgaaagactgggcctttcgttttatctgttgtttgtcggtgaacgctctcctgagtaggacaaatggtaccccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaa

SEQ ID NO: 31141 - protein, 9 aa, Artificial Sequence
  HA Tag
YPYDVPDYA

SEQ ID NO: 31142 - DNA, 27 bp, Artificial Sequence
  HA Tag
tacccatacgatgttccagattacgct

SEQ ID NO: 31143 - protein, 7 aa, Artificial Sequence
  NLS
PKKKRKV

SEQ ID NO: 31144 - DNA, 21 bp, Artificial Sequence
  NLS
ccaaaaaagaaaagaaaagtt

SEQ ID NO: 31145 - protein, 19 aa, Artificial Sequence
  P2A
ATNFSLLKQAGDVEENPGP

SEQ ID NO: 31146 - DNA, 57 bp, Artificial Sequence
  P2A
gccaccaacttcagcctgctgaagcaggccggcgacgtggaggagaaccccggcccc

SEQ ID NO: 31147 - protein, 236 aa, Artificial Sequence
  mCherry
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 31148 - DNA, 711 bp, Artificial Sequence
  mCherry
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtag

SEQ ID NO: 31149 - DNA, 22 bp, Artificial Sequence
  T1
ggtgcggttcaccagggtgtcg

SEQ ID NO: 31150 - DNA, 22 bp, Artificial Sequence
  T2
ggaagagcagagccttggtctc

SEQ ID NO: 31151 - RNA, 16 nt, Artificial Sequence
  Guide
guuuuaguaccuagag

SEQ ID NO: 31152 - RNA, 18 nt, Artificial Sequence
  Guide
cuuuagaccuacuaaaau

SEQ ID NO: 31153 - RNA, 19 nt, Artificial Sequence
  Guide
guuuuaguaccuagagaaa

SEQ ID NO: 31154 - RNA, 21 nt, Artificial Sequence
  Guide
uuucuuuagaccuacuaaaau

SEQ ID NO: 31155 - RNA, 46 nt, Artificial Sequence
  Guide
aaggcuuuaugccgagauuaaaggaugccgacgggcauccuuuuuu

SEQ ID NO: 31156 - RNA, 11 nt, Artificial Sequence
  Guide
ggcuuuaugcc

SEQ ID NO: 31157 - RNA, 23 nt, Artificial Sequence
  Guide
aaggaugccgacgggcauccuuu

SEQ ID NO: 31158 - RNA, 84 nt, Artificial Sequence
  Guide
guuuuaguaccuagaggaaacuuuagaccuacuaaaauaaggcuuuaugccgagauuaaaggaugccgacgggcauccuuuuuu

SEQ ID NO: 31159 - RNA, 90 nt, Artificial Sequence
  Guide
guuuuaguaccuagagaaagaaauuucuuuagaccuacuaaaauaaggcuuuaugccgagauuaaaggaugccgacgggcauccuuuuuu

SEQ ID NO: 31160 - RNA, 90 nt, Artificial Sequence
  Guide
guuuaaguaccuagagaaagaaauuucuuuagaccuacuuaaauaaggcuuuaugccgagauuaaaggaugccgacgggcauccuuuuuu

SEQ ID NO: 31161 - RNA, 16 nt, Artificial Sequence
  Guide
guuuuguuaccauaug

SEQ ID NO: 31162 - RNA, 18 nt, Artificial Sequence
  Guide
uauaugaccuaacaaaac

SEQ ID NO: 31163 - RNA, 19 nt, Artificial Sequence
  Guide
guuuuguuaccauaugauu

SEQ ID NO: 31164 - RNA, 21 nt, Artificial Sequence
  Guide
auuuauaugaccuaacaaaac

SEQ ID NO: 31165 - RNA, 38 nt, Artificial Sequence
  Guide
aaggguuuaucccggacucggcucuucggagccuuuuu

SEQ ID NO: 31166 - RNA, 11 nt, Artificial Sequence
  Guide
ggguuuauccc

SEQ ID NO: 31167 - RNA, 14 nt, Artificial Sequence
  Guide
ggcucuucggagcc

SEQ ID NO: 31168 - RNA, 76 nt, Artificial Sequence
  Guide
guuuuguuaccauauggaaauauaugaccuaacaaaacaaggguuuaucccggacucggcucuucggagccuuuuu

SEQ ID NO: 31169 - RNA, 82 nt, Artificial Sequence
  Guide
guuuuguuaccauaugauugaaaauuuauaugaccuaacaaaacaaggguuuaucccggacucggcucuucggagccuuuuu

SEQ ID NO: 31170 - RNA, 82 nt, Artificial Sequence
  Guide
guuuaguuaccauaugauugaaaauuuauaugaccuaacuaaacaaggguuuaucccggacucggcucuucggagccuuuuu

SEQ ID NO: 31171 - RNA, 14 nt, Artificial Sequence
  Guide
guuugagaguuaug

SEQ ID NO: 31172 - RNA, 16 nt, Artificial Sequence
  Guide
caugacgaguucaaau

SEQ ID NO: 31173 - RNA, 17 nt, Artificial Sequence
  Guide
guuugagaguuauguaa

SEQ ID NO: 31174 - RNA, 19 nt, Artificial Sequence
  Guide
uuacaugacgaguucaaau

SEQ ID NO: 31175 - RNA, 72 nt, Artificial Sequence
  Guide
aaaaauuuauucaaaccgccuauuuauaggccgcagauguucugcauuaugcuugcuauugcaagcuuuuuu

SEQ ID NO: 31176 - RNA, 14 nt, Artificial Sequence
  Guide
gccuauuuauaggc

SEQ ID NO: 31177 - RNA, 34 nt, Artificial Sequence
  Guide
gcagauguucugcauuaugcuugcuauugcaagc

SEQ ID NO: 31178 - RNA, 106 nt, Artificial Sequence
  Guide
guuugagaguuauggaaacaugacgaguucaaauaaaaauuuauucaaaccgccuauuuauaggccgcagauguucugcauuaugcuugcuauugcaagcuuuuuu

SEQ ID NO: 31179 - RNA, 112 nt, Artificial Sequence
  Guide
guuugagaguuauguaagaaauuacaugacgaguucaaauaaaaauuuauucaaaccgccuauuuauaggccgcagauguucugcauuaugcuugcuauugcaagcuuuuuu

SEQ ID NO: 31180 - RNA, 108 nt, Artificial Sequence
  Guide
guuugagaguuaugugaaaacaugacgaguucaaauaaaaauuuauucaaaccgccuauuuauaggccgcagauguucugcauuaugcuugcuauugcaagcuuuuuu

SEQ ID NO: 31181 - RNA, 110 nt, Artificial Sequence
  Guide
guuugagaguuauguagaaauacaugacgaguucaaauaaaaauuuauucaaaccgccuauuuauaggccgcagauguucugcauuaugcuugcuauugcaagcuuuuuu

SEQ ID NO: 31182 - RNA, 14 nt, Artificial Sequence
  Guide
guuugagaaccaug

SEQ ID NO: 31183 - RNA, 16 nt, Artificial Sequence
  Guide
cauggugagugcaaau

SEQ ID NO: 31184 - RNA, 17 nt, Artificial Sequence
  Guide
guuugagaaccauguaa

SEQ ID NO: 31185 - RNA, 19 nt, Artificial Sequence
  Guide
uuacauggugagugcaaau

SEQ ID NO: 31186 - RNA, 64 nt, Artificial Sequence
  Guide
aaggauuauccgaaauuguaugcccgcauugugcggcaauaaaaaggcucgaaagagucuuuuu

SEQ ID NO: 31187 - RNA, 46 nt, Artificial Sequence
  Guide
uguaugcccgcauugugcggcaauaaaaaggcucgaaagagucuuu

SEQ ID NO: 31188 - RNA, 98 nt, Artificial Sequence
  Guide
guuugagaaccauggaaacauggugagugcaaauaaggauuauccgaaauuguaugcccgcauugugcggcaauaaaaaggcucgaaagagucuuuuu

SEQ ID NO: 31189 - RNA, 104 nt, Artificial Sequence
  Guide
guuugagaaccauguaagaaauuacauggugagugcaaauaaggauuauccgaaauuguaugcccgcauugugcggcaauaaaaaggcucgaaagagucuuuuu

SEQ ID NO: 31190 - RNA, 20 nt, Artificial Sequence
  Guide
ccaagugauaaacacgagga

SEQ ID NO: 31191 - RNA, 21 nt, Artificial Sequence
  Guide
gucaccuccaaugacuagggu

SEQ ID NO: 31192 - RNA, 20 nt, Artificial Sequence
  Guide
gccgccauugacagagggac

SEQ ID NO: 31193 - RNA, 20 nt, Artificial Sequence
  Guide
aacugguaccgcaugagccc

SEQ ID NO: 31194 - RNA, 20 nt, Artificial Sequence
  Guide
caucaggcucucagcucagc

SEQ ID NO: 31195 - RNA, 20 nt, Artificial Sequence
  Guide
aggugccguuuguucauuuu

SEQ ID NO: 31196 - RNA, 20 nt, Artificial Sequence
  Guide
ccaguuguagcaccgcccag

SEQ ID NO: 31197 - RNA, 20 nt, Artificial Sequence
  Guide
ucuccccagcccugcucgug

SEQ ID NO: 31198 - RNA, 20 nt, Artificial Sequence
  Guide
ucugugaauguuagacccau

SEQ ID NO: 31199 - RNA, 20 nt, Artificial Sequence
  Guide
ccaugggagcagcuggucag

SEQ ID NO: 31200 - RNA, 20 nt, Artificial Sequence
  Guide
gcaagagacccacacaccgg

SEQ ID NO: 31201 - RNA, 20 nt, Artificial Sequence
  Guide
acaccggaggagcgcccgcu

SEQ ID NO: 31202 - RNA, 20 nt, Artificial Sequence
  Guide
cgucugggcggugcuacaac

SEQ ID NO: 31203 - RNA, 20 nt, Artificial Sequence
  Guide
cuacaacugggcuggcggcc

SEQ ID NO: 31204 - RNA, 20 nt, Artificial Sequence
  Guide
aguccgggcugggagcgggu

SEQ ID NO: 31205 - RNA, 20 nt, Artificial Sequence
  Guide
gcugcgggaaagggauuccc

SEQ ID NO: 31206 - RNA, 20 nt, Artificial Sequence
  Guide
acagcggguguagacuccga

SEQ ID NO: 31207 - RNA, 20 nt, Artificial Sequence
  Guide
cagcggguguagacuccgag

SEQ ID NO: 31208 - RNA, 20 nt, Artificial Sequence
  Guide
gucaagccccagaggccaca

SEQ ID NO: 31209 - RNA, 20 nt, Artificial Sequence
  Guide
gccuggggccccuaacccua

SEQ ID NO: 31210 - RNA, 20 nt, Artificial Sequence
  Guide
auuuucugacacucccgccc

SEQ ID NO: 31211 - RNA, 20 nt, Artificial Sequence
  Guide
auccuggccgccagcccagu

SEQ ID NO: 31212 - RNA, 20 nt, Artificial Sequence
  Guide
ggagagcuucgugcuaaacu

SEQ ID NO: 31213 - RNA, 23 nt, Artificial Sequence
  Guide
ugcaguccgggcugggagcgggu

SEQ ID NO: 31214 - RNA, 135 nt, Artificial Sequence
  Guide
ugcaguccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31215 - DNA, 43 bp, Artificial Sequence
  Guide
ctgttgctgcagtccgggctgggagcgggtggggagcagaggg

SEQ ID NO: 31216 - DNA, 43 bp, Artificial Sequence
  Guide
gttaagagacagtccaggctgggagcaggtggggagaggaggg

SEQ ID NO: 31217 - RNA, 22 nt, Artificial Sequence
  Guide
gcaguccgggcugggagcgggu

SEQ ID NO: 31218 - RNA, 134 nt, Artificial Sequence
  Guide
gcaguccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31219 - RNA, 21 nt, Artificial Sequence
  Guide
caguccgggcugggagcgggu

SEQ ID NO: 31220 - RNA, 133 nt, Artificial Sequence
  Guide
caguccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31221 - RNA, 20 nt, Artificial Sequence
  Guide
aguccgggcugggagcgggu

SEQ ID NO: 31222 - RNA, 132 nt, Artificial Sequence
  Guide
aguccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31223 - RNA, 19 nt, Artificial Sequence
  Guide
guccgggcugggagcgggu

SEQ ID NO: 31224 - RNA, 131 nt, Artificial Sequence
  Guide
guccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31225 - RNA, 18 nt, Artificial Sequence
  Guide
uccgggcugggagcgggu

SEQ ID NO: 31226 - RNA, 130 nt, Artificial Sequence
  Guide
uccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31227 - RNA, 17 nt, Artificial Sequence
  Guide
ccgggcugggagcgggu

SEQ ID NO: 31228 - RNA, 129 nt, Artificial Sequence
  Guide
ccgggcugggagcggguguuugagaguuauguaagaaauuacaugacgaguucaaauaaaaauuuauucaaaccgccuauuuauaggccgcagauguucugcauuaugcuugcuauugcaagcuuuuuu

SEQ ID NO: 31229 - RNA, 128 nt, Artificial Sequence
  Guide
aguccgggcugggagcggguguuugagaguuaugugaaaacaugacgaguucaaauaaaaauuuauucaaaccgccuauuuauaggccgcagauguucugcauuaugcuugcuauugcaagcuuuuuu

SEQ ID NO: 31230 - RNA, 130 nt, Artificial Sequence
  Guide
aguccgggcugggagcggguguuugagaguuauguagaaauacaugacgaguucaaauaaaaauuuauucaaaccgccuauuuauaggccgcagauguucugcauuaugcuugcuauugcaagcuuuuuu

SEQ ID NO: 31231 - DNA, 28 bp, Artificial Sequence
  Guide
agtccgggctgggagcgggtggggagca

SEQ ID NO: 31232 - DNA, 28 bp, Artificial Sequence
  Guide
gtcaagccccagaggccacagggacaga

SEQ ID NO: 31233 - DNA, 28 bp, Artificial Sequence
  Guide
agtcctggctgggagcaggtggggagag

SEQ ID NO: 31234 - DNA, 28 bp, Artificial Sequence
  Guide
gccaagcctcagaggccacagggcagca
